United States Patent 6,812,339 (POLYMORPHISMS IN KNOWN GENES ASSOCIATED WITH HUMAN DISEASE, METHODS OF DETECTION AND USES THEREOF) - sequence listing, part 44

SEQ ID NO: 14319 - DNA, 31391 bp, Human
  misc_feature (1)...(31391): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctctgggaggtcctcacttcctctgcacaaggcaggcaggtcaccggccctgcgccctgctcatctccctcagggccacctccatggccaggggcaggcagagggcacaggggtgcccagtcaccaggtctctctgcttcatatcagtggacctgggctctgaggggggccatcaaggcatcaggctggcccactccgtccttgagtcagggtcctacagactgacaccaggtgggcctgcaagaccctcatctgcatggtcctctcatgcagggtgggcctggggaggacccagcccggctgagctgactcccagcacttctccaggtgcaggggcagcctggcagttgtctgaagaccccgggatgcacttaggagctcatcggtgaggcccggtaggtgccccgagcagaagattgagaagggacacctgcacccctgtgtggtgtgtgcaggggcgtcactggattctctggccccatgcctcacaccgcccgtggggggctggcttggtagagtggggggatactaagcaggtgacctcggagagcgtcttctgggtttggagcccccattccgcagaagggaagaggtgggggacccctgcagggttacgggtaacatcaggcctaggtcccttctctaggatggtgcagagagggccacaaaggcccaggagggcccccagaactctcttaagccctgagcctgtttcttactgaaaaatgggggcgatcgtgctgcagcaaggggcttctgtgcagggggcgggggattcatgggtttcgtgaggccaggaagggagtgggtcaggcagaggccattcctaggcctcgggacaaagcccttgcccgcttggggaccgggccagcctaggccgccacaccctcgggcccgcgtccccggccggctccggcccgggccgccatcccctccgccgcctgcaggggccgccgcctcttcaggaatgcgccgcctttgtctgggaccgcgcggcgccggtgcaccgggcgggctgagcgcctcctgcggcccggcctgcgcgccccggcccgccgcgccgcccacgccccaacccccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggaggtgagtgtccgcgctgcacccgagcccggccggcggcggggcgcggaggggggcggctcgccccctccccggagccgcagggcccgtcccgggctgccgaggcgagggaagcgtagccgggcggcagggaaagccaccgcagtgccgcgccaggctggggccgctggcgccccggccccgggagggcggagccggaggcggcaggaaaagttgccgcttcccgggaaagttgacggcttcggcagggccgagggtggcggtccgagggtccccgatgctgggccaagtcgagggcgggggccgtgggctggaagggcggggcccggcctcggagcgccccggccaccaaggggttaacgagcgggtttttgcagaaacgtgggtaccgagggtgggtgggggtgtcgggccgcctccaccccagcctcacggtttgggctcagaacctcccgtttctccgaggtcagtccacagtgggatgaatgggggcgttggcggcagtagagggcgtgggggacagggttgtcccagcgctgcctccagggcgggcggtgagaggaggcagcaacgcccgccatctgcagcccgagggacattgagaggcttggctgggggaatcaggggcggtggggcaatcagcaacccctccctagcagccctcgtgggactcccccgccccaccggctgtgaggtcccgcggtgcgggcaagggagggtgggctccatgtgagttgggcatgccccgcctggagggtgctccccaggtgcccacccaggctgccctgctgatgtccatggtgccgcaggctgcacacacgtttccttgcacgtgcacatgtctacacggactgcacacttgcacacctctggtgcacatgcgtgccagcgccaccccagtgtgcacatgcacaaacactgggtgcacacacggactctgagggtgcatatctgtgtcctcgcccccgcttgcacgcccacggccacacatgcatgtacgcgacatgcctgctgtggtctccacgggtggcacatgctggggcccctttcacaatacccactcccgcacccacatgctcgtctgttgagtggggaggccaggcccacagacaggggcaagacatcctgggccccacctctgcctgcctgcctccgtgtcctgggggtccccgcctcgggcttgtgtgcgtgtgtgtaacttggtatgcatctgcacgtgtgtctgtgcgcgtgatcatgtgtgcctgcgggcacataggcatgtctctttgcctccagggtgtgggtgccccttgtgtgcctagacaggctgtggcctaatctggagcagaggccctggaatgtgtgttgggggctcgttgaataccgcaaagcccagggtgtgaggggcagggtctcccagccactccctacccaccagggctgaggcagatagatgatggtgggctggaacctgtctgggcagggaagacccatttcaggccatgaggtcaacactgtgaccaacaggccagaccctgggcacccttggtggccgctgcagcttggctgactggagcacgtgacccagcgtgactgcagaggccccgcctccagtgcctcagtttctccatggtgaggaccttcttggtgaggggttctgtggtgggctcccctacctccggtgttgtgtagggtgctgagcagatggatgccatgctgcatgatgggcaagggtggcccactagcactgtggcaagggccctgggctggggcttggattggcaggccacacctcctgctcccctggccaccaccagaggctcatctatagagtggggaccagcaggttatccttgtaggttgtgtgagggtgaaacatactagcagaggggcagctgaagcagtggggctggccagtctctttttctaagcctcagtcttcccatctataaagggggtactgttccctgttcttctctactgaggtgaggaggaagtgagctcccatgccgggggtgggaatgggtggccatcagcacctagacgccacctggcagaggggcacgtgcagggcctgccgtggcagaaccgtgacctggatttgggtcctggctcagccacctgctggcggtgtgaccttgggtgtgacaggtcgcctctctgcctcagtcttcctcacctgcaccatgggccagtggtcagggattatcggggcacttccaggctgaggctgggcggaattggcccggctttccctgtggagttctgactctggtgcttctgcctcagaatgcccacaacacctccccacacccccactcagcagagtcctcctgggacctttgcactgccagctggcccctcaccccatccatgtgcagaagggacaataaaagcccctagtcaggcaactcgggccacaggtgagtggagaggggacagggcagggatgctgcccagcttgggagaccctcccatagtaccttcactccctccctgccctccccctgttcctcacctgggggtctgtggaacccctgagcctcagtttccccgtgccagggtccttctgctgggactggcagaaacgtaggtttgcatggagtgagaagcaggggagaggctgagggagggcctggcccagcacgtctctgaaagccagagggcttgtggagggtccatggaggacacccctacaggggctggggccctggaaggtgggggaaggtcctgctgtcctgggaggctgggaactggcccacagcctgtggaggggccagggtttgtttgctgttgctgtgagtgacaggcaggctgtgagggccagggtgtgtgggaccgtgctctccccctccctctgcccaggaacagtgcagccttgtagcattgccctctcctcgtccctgccccagccttgaattcatgctttgtggcacggacggccctgtgcagccggtgcaacaccaggagggtccagctggtgaggacaggacgggcgggaggcagaggagccctcctgctgtcctgggcctgtggcccggaacctctcaccgggagccttggtctgtgcacctgggaaaggggtcaagagcaggaagcacatggggagtttcaggatgacctggaaatgaacaaatgcgtgtgtgagccaggcgccccgcccggccctggcacagggttagtgagggctcctgacacttggctactatctgatcaatgaggttcatgccgtcccgcccccattctggtgagcctgacctctgacccccaggctggtctgcctgaccctctgcagccacccagggcctgggcctcagggtctgcgggagctggcttggccgcctgctgcctctgcagctgtgcagatgccctctcgggtccctctctgcacccctcagtgtccctgctctgcggtctggctgcacccaggccaaggtcacaggcaccctcctcaaagccagatcccagatgctgcatttgccccaaccatccattcactttctcatttgttcattcattcactcgttcgttcctagcctgtcagattctcttctgagccaggcaaatcaaggggtgtgatccttggcatcgggcatctctaggattaaatgctttaaaggataggaggtcacagagtggcccagggaagcccgatcggagtggcgggcatgctgccccaccccacaaatctccctgcactgtccctggggcccagctgggctcccccacaccaggtgttctgtgctgccgtttcttcttttatcgctgtattttaaacactttgcacatcgggaactattcttgtgcatcatgggttttctggtgtgtgtggaatcccttcctgagaatgcaccatcatttatttatccaaacctgcaccggcctcctgcactgcctgcagccgtggagctgggcactgggagatgcagctctgcacacccaccccaccatgtcctcagctggcacccaccaggtctaggggctggtcacgtgcctctcccctgatgcttgagctgatttcaggggactcggcagcagggccagatcccgcccctcctagccagctgaggcctttgacaaccgtgggctggccgggtgggtgatggtgagtgagtagagtctgggcatccatttgtgcagtgggtgccttggggccgcctctcctctccctctttcacacagcctctggtcttgcccgctatggcctgcggggcctcttctgcggggcagcagggcagcggggcatggggtgatgctgacactgttccgcagctgtgtcctgtccgatggaggcaacccacagcagccagaccaggaggtggagaagaaaggcagggcagttggcacacctcgagagtggccttaggaggggctgagtgggcacaggccagggtccccatgtaggtctacacaggcctggcaggtggaaagccccattcagggccctggcacatggagctgggctgatctgggagtgaggtgtcgggtgctgacccagcctcactcagagcagcctgccctgggcccccgggtgcctcttggctctccagtcagcaccctggcattcttagctggctgtcacgggtcacggtccatggagttgaaattctttggaatgttgggggtatcacataagggctttgtggtcaaatgtgggacctgctggaataaatggtgctgatggtgctcctttcccgcagggcgtcttgggccctgttttggagaggggtgggcagcaccttctctgagaggcacccctatgcgatgtacctcagggcctggtgtgcccaggaacctgttttgggaaacagtggttgaagtgccccggaggaccagaggaggagacctgtgggcctccagcaagggccctgggatgggtagaccctgccacacaaaccccgcacccacggggcgcccagtgggtggagggaccactgcttctcccagcaatttgaggcgatgtgcaaatttaacctttggatttatgactctatttctttgcagcaaatgtcacgggaaatgtcaggccaaggctgaggctgggtgaggggcccgtcaaggaagggggcagggctaggcaggctggagtgccaaggaggggctcaggccagggtgggctccaggcccctcacctcctcctgggagccttcctggattgtcccttgcttgcctggatccccggctatcacaaccttgttgagatgttgcctttatttgccttctgccagggcccagctcggggacatgccagaagtcccccattccccaaggctgggcagccatgggtaagcttgtgcagtgctggcttgctgtgtgaccttgggcagctccacccttcctggtcaccgtaggcctctctgcagtccacggctggtagccagaggtggtgttcccagctcagtgtcttcaagagtgggaaaatgcctagagtcctcagtgtgtggggtgtggggctctggaggaagtgggtgggggctgagtgcaggtctggggttgtggagggctggcccttggtggtcccaggggctagagcagcccctgcacacagcaggtgctcagtaaagaccaaaatgcagtgcgtggatgtggaaggtggaggtggattccagctgggagtccacagtccccagttacatgtcccccctccgctgccacatgccagatgtcattccaaggccccagcctggcccatcacccgctctgccctgcctcccaggtcccggcaagtgagggaatggtgactgcctcctccctgccgtgtgcccggcctgtgcactggagcaggggttcaggctccctagtgccctgcatctctcctgcacacacagctccccacactacacaccttgggcctccagatccagcctgtctgctagtgtcacatcctccgtacccaacgtccaagcccagagtctcagcctcttccctcgacccatccccaaaggcaaaatcagtgtcaaacctgcaccctgtctcccggtccatcccctttactcctcactgagggccatcctcagacctggcctctgtccccggcctgtggccacagccggccccggctcccggcctaccatcttgttccccaccccgggattcaagtgcttccctaagacatgtttccagccaggcactgcctgcctaaactcccccatggctgcccctaggtgaagctttggccccttcgttctcagggcctgggctagagggtctcatgtaggaaccttcttttccatcctcaccagggaagcccccgtccctagttcccagtgcctggcacctgtgtctgcctacccctctccacttgaagagcccaggcctagcttgaggatgcagaaagccatgaagggtgggacagccacactggcagggagggagggcccaggcgccggtgaggaggatcagttgcacctttgtgggcagtgcctggtgcccttctgtccctgggtcagctccgggagaccccagggttggtggccttcaagactggctgttaggtgcagatcagttggcccagccggctgcacaagggttgctctgtttcccccggggagccacctaccctctgagcctccctgtccgcacgtggctatcgtgaagctggagcggtggtgagtgagcactgcccacaggacccggccatagtggcagcttgatttgggcaagctggaggctcctggtgcacctggctccagggaccccttcttccaggccaggccccttgcacgccctttcctggcctggactaaactagctgtggaaatcgagactagtgattggggccttagggccttgtgggaaggggtggcaggtccctcacctcctggaggcctcccaggttttcagcccttcttacctgtcctgtcctgccctggggggatccaggctggactctgaccagcccacgtggccagtgaggatgggcatgtgggccccactgtactgcctggagcaggagcctctgctgaaccctggtgggtacagagaaggaactgctctctggggccactcctccccatcggtccttctgccgtgagggtcctcgtaggacatcctgagagacacgttagttcatgccaggggagcccaaatgacagtggggctgagaggctatgacggggtgggagtggggtgcacagggtccgggcagggctagcagctgtggagtccggaggggaggctgggtgcatgtggagaagtccctagttctcagtgaggagcctacggtgcagtttgggttccagcaggagctctgccgcaggacctctgcactgactcagagagaagtatggggtcctctgcctttgttgtgtggaggcttctgtcccgcccttcacttgtgctggccttgcagtgcagttggagaggatgcctcgtccctgactggtccttgggcagagtcctcagttgtggtagggcggggtgggactgggtattgggagggtgggccacctgcccccgggcgtggcccctaccccagaagccccttccacctacctggggaactcactcacccgggcctggccagctaccagcacggctgtcgagggagggctgaggagctggcccaaggtcacgcaggatgtgctgcgctggtgctcctggccccacctgcctccacgcatgccaccaggaacctgggagtcagccctggtgccccctcctttgtggagcccagcaacgttccctcccacacactctccacttgagtctccgcttccctcctggctctccctggacatccaggcccccttgtcagggagcatggagctggccggtcacgccctgcccagccccagggtctcctcagggcctcccgagggatggggctgtatgaggtggtagcccatgagcccagcagggattggcttcttggggctcccgtgggggctacagatgagccccctagggccacgtgagacaacagcaggactgccacagttccctcagctgggtgcgtcccctgccccacccgctggggccatgggggactgtggacttgagtgtggcctgccaggtgaaccccaagtgtcccctggggagggtcctcccctcctcatccttggtgcagtttcaggcaccaagatgcactcccagtgggccctggtccagtccccgatgcaggggaggcccacaggggtcacttgcttctcccttcattctcttagcaaattcttcctggcatcagttctaagatagtcccatgctgggcggcagggaccttgaggttcttgacatgctctacccccaagtcccccagattccagggaaacatgctgaagcccacaaggtccctaggagtggcagcgggggtgaggttgaggactctgagcctcccacattgaccgctcatgaaagccacactggccccaggtctggaagaggagctggagctgctggcctgggggctgaggaggctccagtgtcccctaacagaagcccagtggctgcaggacaggccactgcccgggtgagatgcttggagggctctgggttgggggagggcaggtgaagaacttgtgggtccagaggggagtggagggaggggcagaggctgcggaggtggactgcggggcgagctctccttggccccagcaggaggctgcctgcagctctggtgctccctcggcctgacacatgggccctgcgcacccggctgcctccaggctgtctttcatctccctgcctcggccccaatttatgtcaggcagaggctgacacagggacaggtgtgacaagtgtctggcttcctatttgaaaactggcaaaagaaaaactctccccataaagatattccatctacatacctcccggatgtcaccgcgaggacccgtcatggctgagacagatggcggccctaatggagtccattcttcacccgctgccggagcggaggccggtcccctggggtggcctgaggcggatgatgggtgatgggtggggcaccaacctccctttgtgccctcccctatgccttggcctgtccccaaccccgagctgcccaccagggcctctgtcatagccagggactccagggacaagtgacctggacacctgaggccccagtggtccagtgcctctaccctcctggctgagagacggtgcacacttgacccccagccttggtccagcgcctccaccctcctggctgagagacagtgcacacttgacccccagccttggtacatgtcaggaccacccccacgccccactcctagctgagttatcacttcctccgggaagccaccccaaccaccccacctgaaggtgctgctactgccccctgcaggcagagcactccaggaggcagggtactcaggatcccctggcccccagatcacagggagcttgatgttgcaggacggtctccatcactgcttctgggtctcgaggtgatgagggccctgccctgggagccaggggagtagcaggctactcaccagtgaattgaggggaggggagggctgcagtcctgcatagccccccgtggctcactttctgcctgggggtccaccgtgttcaacatcctcacttgcatggggctaccccaggcccagggtgaggttgagacccacccagcctgtcactcatgctcagccaagcttgtgcccctccctgcctgagtactccatgggcaggagcttatgggccattacccagccgggctcccatggtggccccattgggtctgaggatggacaccttgggcaaggcagtggtgcagacgaggaagggattgggaaggggccagcctccttaggggtggcaggggtggggctgggggagaagagccccccagaggaagtgtgtctgggaatagggcagggcattctggagggggagctccttgagcaaacgccagcaggggcaatggccttggagcaacagagccccgggtggtgctggcttcaggcctggcgtcagggccaggtaggatgccagcagagcacttcctggctgcaacttggccttggagctgggctttctcctctgtggggtggggatggtggtccctccgggggtgatgtgagaaggtcctccagggagaggccaggtgcaggctgccccattctttgtgggtgccatgaggtgggccttattatctccatttccaactgagggaagcagttctgagacgttggggggcctgcctgagacctccctaggcagagccagggccccaagccctgaactggttccaggactgccctgcagggccgatcacgttgggcagggaccctggggtgtgggggctcatggagggggctcctgccacctgcaagacggactcacccacccttccacctggcccagtgtcagcataagaccaaacagaacaaacgaaaaacactcttgattttatgaggtcatgttcattgtagaaaatctggaaaaatacaccaaagttttaagaaagaagttgtattagtctgatcaagctgccatgacaaaatacgatagacaaggtgtcctaaacaacggaagcacatttcctgacagttctggaggctggaagtctgagatcagggtgccagcatgggctggttctggtggaagttcccttcctggcttgcaggtagccacctccttaccgtgccctcacgtggtaggggatggaagggtggagagagaggagggcatgtactctctgaggtctctttctcttccaggccactaatgccatggtgagggccccagccttgtgaccttatctaaccgtaatcacctcccaaaggccccgcctccaaataccatcacactgggggttagggcttcgacacgtgaatctgggggagacgcagatatggagctgtaacagaagtaaagctatccatgttgctacttagagaccgtgcccttggcactggggtgctggagccatgcccccaacccaggaacatccgttgcctcatgggctgtgggccaaggctctctcccagggctggacatcctggggaatgctgtctctatagctgcacaaagcctgccacttgcccttagtggtgagcatttagtgcattcacatgactaacatttatggagcacctcctgtatgcgggtcaccagcccctgtggagcccaaagcccagggtgcctcaaccgacagaaacaagctacacagaagcctgctaagtgggccagcgaggtgtggagtggaatgggcaccctggcagtgggcagaaggtggaggggtgtcaaggagaccgtgggagtgggcccacagaagtgcctcacccagacccagccttcccatttctcagatgagaaacccagccaagaagcacaggtggtgcctgagtagggccatgtgactgggcctgggggtgaccgggcctccaggcctgctgcagccatgatcggggtcggagaagcagccagtggaggagtgagcgggacggggcatggcttcctgcaggcctggcctgggagggaggcaccggctggctggctgcccggtgggttgcaaggttttaaatatgcattaacagaagaggtgctgaggcctggcccaggggctgccctgaacaggctgagtccctgaaccctcctctgtgaggctgggggaggaagaaaaggggatggggccagggctgttgtaaaatcatcaggacaattttaggagaatggcttatgcctttgcaggtttgagaagccaccgtggggtggcccgggcaggccaggagaccagctgggtgctggagtgtcctctgtgggatgaaaggtcaggctgcccagtctttggggcttacatggggggatgaatgcagtatggcctgtgcatggccccctgacccctgatgaccctgtggtgacgcccagtgtggccttggacttgagggacccctctgtgccctgggctcagtggcgtgggtcccagacagagatgctgaggaaataaggccggactgccccgcctcccggagggcagctgacccccttccactggccctgcgcagtggggcggcgcatcagcctcaggaagtagctgaaatacactgacctcgttttccaagaggcagcggcacctgggcctcccaccctcgtggatgagaagccgacaacagtttccatcccaaattgatttcaaataaggaagagttatcacacacaatcatataggaataatttatcacttgttaataaaagagcaattacttattcacgtcgccgctgcgtgcgtgcctcggtttggttgtggagacgcattgggggctctcatagcagctgagagaagcccgtgtgcacggtcagaaaggaggctgggggctgcacacccaccccagtgctaggcgacccctgctgggtgttgaccacacacccctacccccggctcctgaggggccccagcctggagtggggggctcagatctgtgacaaggaggggacaggagcgggcaggggtaaggggaatccaggggtggggcttcatcacagtgtgagggctgggctgggtgggcaggcaggaactctgaggctggttcagggaagcagctgcctggcctgcagggaaggcccaagcacagagttgggcttttaggccagaagctgccccttcgggtgtctggattgcagagtctctggggccaagagcccatagtgtcctgggagacccagatgtatcctcagccacccttggccgagcaggggaccaaaaagcagcatgtggatcctccctggccagatgccagctgccctggggctgtatgtccaggtgctcttgagctctcactgtccctcgctctcctcctgcaccttggagacacctgcttctaacctacatttgtctccaccttctggaagatacactttcttttttttctttttatttatctgttttctgagattttagtgccacatatgcagttgttttaaaaaataataacattcggtcaacaacatattgcagagttaacacctgcacccagcctcggaggctggtctggagaatgggctcaatctgcccctgccccgcgtcctcctgggaggcagccactgtcgcctctgttccctggctttgccagtggttgccgccacatttcctcagcttctactccagctctgtctcctccagcacactccccagcatggctgtctcgctgccatcagttaaattcacagccagtgtttcccaacccaggtcccataaatgttcttctcaatcctgccgtgggatgggtgaccttccttctctttcatggccttttgttttccttggggcttacagttgatgttttttacccatccaccaccctcatgggcttactcttccccacatcagggcttctattggggtctcatttttttccctggataaagattcaccccaagcacttgtcctgctgccccataacttccctttaccacctgttgaaatttcagttaatgcttcctgggccccacgttttcctctttctgggtttgcacctcattttggctgaaacataagcctgactcactctctaaagaagatatggtgaagaatcattccggaagtcttcctgtatttacaagtatgttcaagctggattgtttcggtctagaattccatgttgaaattagtttcccctcagagctatgaagctgttgcagtgttgttgtttcctggcatctagtgtgctatgaaggaggccaataccatagtgcatcttctttgttgtgtgtttttttggagaaagtctcactctgtcacccaggctggagtgcagtggcatgatcatggctcactgcagcctcaaacttctgggctcaagcaatccttccacctcaacctcccaagtagctgggattacaggcatgcatcaccacacccggctaactttttaattttttgtagagacagggtcttactgtgttacccaggctggtctcaaactcctggcctcaagcagtcctcccacctcagtctcccaaagtgctgggattaccggcgtgcactgctgctcatggcttcgtgttgcctctttgtgaccagcttctcctcctggagcttcagacttcccttgacccctgggggcctgaaagtgcactgtgaatgcccagtggaggactgggtactcagctttgggaagttttctggtattgtttctttgctagcttttctcagtttttttgttttctcttctggaactccccttggatgttcaacctatatttgtctcccaaatctcattcatttgtctttctcctttgtttttctttctggaagatttctttgaccttgttttctaacacttgtattgattttttttttaattttagtgattctatttttaatttccaggcactctttctttttgtctgatgcctccttgttcatagcagcctgttcttgttttaaatccccatctatgcctaggaagacacaaattagatgtttctcctaatttttgtctttttcccacactgtcggcttcctctagcatcattctccctctttttctgcattgatatgttttccggatgcctggtggtcactggttttctggtcacttttatgagggaagctggttggctgctctgctgagatggagcttttcttctgcccatcggccctgggtgctcctggataccagtggtggaacccctttctctgggtgtttctccaggggagcagcctgccactgtgctccccactcctcactctgcatcaccctcatttcggtgggtctctggaaggggaggaacacgtgtctttcatgcagatccccgtgtctaacacatggtgggtgagcaggggagggggaccatcagtgttgcatgagaagccacagcaactcgactctgagcacaggccgggtctctcatgagatgagtcaggctgcaccaggcctgtcctcaagccttctttctctgctgaggctgagatgggcagaagcagcgaggaagtggctccaggtgggtttgtagcacagcctggctgctgccccctcttccagcccagatgcagccaggatcctgcctgccatatctcctcaataaagcagggctactgccaggccaggccagagtggccttgcaagaccgctggagcagaggggtccgtgtggctctgggacgctgtgagctgtaccttgcctccctggactcctcacctgagacgaggctgacccaggtcacattggcaggcctctggggaggcaggatgctgggtgggggcctgggtggggtttctttggggtcctggggggaggtaggtgctggcctctcattgtcctcacatcactggtgtggggacagatttggagggggctggcagattctctgcctactctgtgagggggtgcagaggctacatctgagcccagggctgcaagaccccagggcccactttcagccatccctgggagggcagcctcctgggctgaggttgaggtgccatgggggactagggagcccagagtggctgcccctccctgctgtgtcatccctggggctcagggtctgctctggtcgcctggggatgatgatggtgataaggatagtggtgatgaagatgggggtgggcagagatcttggagtccagattgtgtgcactgtctcctggccttgcaaggtggccagcaaggcacttgcctcagtcagtgcctcatctgaggagtgggttggcagtcaccccctcaccgtacaatgggaggatgcagcacagggatatcctgaaacctccaggaatgaggaaaggctgcaccttgggctgtcccagggaggcgaggggccctcatttcttactccccatcccttgtcctcttcccttccccatccttgggccagggcctctgcccagggatatctggtgtcgacccagtactgacccattgctcacctggggcttcctatccttgtgtgaggtcagccccaggctgccctttatctaagggccttgcacagagctggtgtgatgatagtgatgatgacggtgatgatgatgaagacgatgatggtgacagggatgaggatggtgatgatgatagtgatgaggatgctgatggcggtgatggtgatgaggacgatggtgatgatgaggatggtgatggtgatgatagtgattgtgatgaggatggtgatgatagtgatgtgatgatggtgatgaggatgaggatggtgatgatggtgatggtgatggtgatagtgatgaggataaggatggtggtgatggtgatggtgatgaggatgatgatgatggtgatggtgatgatgatgatagtggtggtgatggtgatgatggtaatggtgatgatagtgatgaggatggtgatgatagtgatggtaatgatggtgatgaggatgatggtgatgatgaggatggtgatgatgatagtgatggtgatactgatggtgatagtggtgatggtgatgaggatggtgatgataatgatgtgatgatggtgatgatggtgatgaggatgaggatgatggtgatgatggtgatgatgatagtgatgaggataaggatggtggtgatgatggtgatgatgatagtgatgaggataaggatggtggtgatgatggtgatgaggatgctgatgatggcgattgggatgctgatggtgatgaagtgacaaggatgaggatggtcatgatggtgatgaggatgatgatggtgatgatgatagtgatgaggatgctgatgctgatggtgatgaggatggtgatggggatgatggggatggtgatggtgttctatagtgatggtgatgaggattaggatgatggtgatgaggatagtgatgaggtcatggtnnnnnnnnnnnnnnnnnnnnttccccatccttgggccagggcctctgcccagggatatctggtgtcgacccagtactgacccattgctcacctggggcttcctatccttgtgtgaggtcagccccaggctgccctttatctaagggccttgcacagagctggtgtgatgatagtgatgatgacggtgatgatgatgaagacgatgatggtgacagggatgaggatggtgatgatgatagtgatgaggatgctgatggcggtgatggtgatgaggacgatggtgatgatgaggatggtgatggtgatgatagtgattgtgatgaggatggtgatgatagtgatgtgatgatggtgatgaggatgaggatggtgatgatggtgatggtgatggtgatagtgatgaggataaggatggtgctgctctggtcgcctggggatgatgatggtgataaggatagtggtgatgatgatggtggtgatagtgatagtgatgatggtgatgaggatggtgagggtgatgaggatggtgatgatgataatgatggtgatagtgttggtgatgatggtgttgaggctggtgatggtgatgaggatggtgatgaggatgatagtggtggtgatagtgatggtgatgatggtgttgaggatggtgatggtgatgatgatagtgatggtgatgatggtgttgaggatggtgttgaggatggtgatggtgatgaggatggtgatgaagatgatggtggtgatagtgatggtaatgaggatggtaatgatgatagtggtggtgatgatggtgatgatgctgctgctgatgattatggtggtgatagtggtggtgatggtgatgaggatggtgatggtgatgatgagtatgtttacaatgatgataacaaggacagaaaatgcctccacagcctacttttccttcacaatcttggctatgggtctgcaggagcatccaggcctgaggccgtggagggtggtccagggcatcctgtttgcaaggagggaccgcactccctttcctctcttgtttcctgcaccaagtgttctcatctttaatatttctttgttattaactgtgaagatccctttagcagaggctggaatcctgatgtcctgggaagtacatcgacacggatctgcccaggtcacctctttccaggccctgtccagcccagggaggcagcttgatgttaatgggtcataagccaccttggtgtgacctggccagagtccctgatacaaggtgcagggagaggcctcggcccagcctctgcagggttccaaggtgggtggactggcatggaggggccctgtccccagagaccccctacctcagttaaacggctgccctcttcaaaactacctgcactggatttgtctcctctgaagtgccacccaagtcctttcctccgaagccggactgtgtcattcagcacttcctctgctgtccccctctccttacaaccattttgttctctttgtgtgtatgtgtgtgtgtgtgtgtgcatgcatgtgtgtgtgtgtaatcccagctactcaggaggctgaggtgtgagccacccctcccaacttatttgtgttaggttgtcctattttatgcatatttgactgtgagactcctgacagcctctttagaaaaatgatcatttctgttttgacctgcagagtatttcagtatttctgagtctctttcttgcctagaacccctcaccctaggcctccgtgagatgctgaccttgcccaggtctccacagagctgagcctgcactgaggttgctgggctctgttcacctggctatgtgacttcagcaggaccgtggtcttctctgacccttggtttccttttcattagtgggggtctgagtgaactgctggggccattgtgagggtgaaggtggcagcacccacactcggcttgctcacaaaccaggtcggcaaactgtttgtgtgaatggtgtgatactaaataattccagctttgtgggccacacagtgtgtcataacaactcagctctgctgttgttgcgggaaagcagccatggacaatgcgtgaacacataggtgtggctggctgccaatagcacatcctttacagaagcagcagccagcccttgggccagtttgccaggtgccagtagaataggaggccaaggcctgtcggctctgacaagggttccactctggcccccggacacggagctctggccttggctgggggaattccaatgggaacatcccaggctgaggaggatcctctcctgcctcttagattcctcatcccctggggagtgctggatcccactggccctgcctggctgagcttctctgtggtcttagcaggcactgcttatgtgccgtgggccagctgctgcccccagctcagtttctaatgtgaagggctgggcagtccctgggatggctccaatgggagcctgtccagctgctgttctgctgactgaggctgatccaaggctgctgagaacaagccggcaagagcctcaggacccacacgtgtcttttcacagcagaataaattctgctcggacagaggccgctcgcctgcctggttgatcatgttttacaaatgctgagggcaagagaacacatggggatgtgcctacacatcttcctctgccgcagcggcatgcagaccctccagccgggccctggctcctgggaggggctcgcatcccagcaaccctctactgctcagtggactctgcctgagccctgaccagccctgggggctcttattgtgtgtttccggtatgcacgcctatcgtgtgcacccccaggggtcccattgcatgcactgagtctgtgctcctggctcgtgcaccctgagcatgtgctcttgtacttcctcctgccctgtcaaggccgacactctgggctcacaggcagtggtcagccttgtgcatgcagcagatccagggtcctgggggagtgtgggagggctggggcttaggtctggatgctagcccatgggagtggatgtgggccctgcagggctaggcaccaggtagcgggcagggtcaggcaggcagatgggcatgggaggcaggtgtatggcagtgctgggcccagacctggctcagagtgcgtccccagggtgggagcaggccggccaccggtcacttgctcattagtgtcctctggggactcagcttgctctggctgctggattgaattagctgcaggaccaagatgagcccttggtggagacaggattctccagataattaggcagcaggtgtttgttggctcctggtggagcatggaggagcaggtgggctcaagcctcctgtggggcaagggggcactggctgtgccctgggctgggcgaggcctccactgggcagagcctccaggggcccccagtgtggggctcactggggtgggagccgaggagggtgcacctccagtgaggggtgtatgggctggatggggcaaggttctggagccctccacgcaggcagcccagcattgaccaaagatgaatcctcgaggcctaggtgctaggccaaggatcctgcccacttggggctctgccaagaccctttggctggtagtgggctcctgggctcctgccaacatcctcatgctgcctggggctggctcaggcctctgtggctcctaactctcccatagggcacctgccatgcagcagggtggctgcccgtggtcagctggccctggaccgtgagtgcctgggacccggctcctcggcctggtcttgtatgggcggcactcagcacagcacctgggacaggggccacttcacaccttgccaaggtacggagggagggccaagcgagtggatgatcctgcacggtgtggcccacgttgatgtgtccttggggtgagggtgccatccagggctgccagctctcacctgggccaggccatcctctgctagcttcagtgtctgtgacttgaaaggtgtaccctctcaggtgccctgctggctggaaacaggactgtggagctcaggttaggagcgggggtggctgagcctttactgcccagcaagaccttttcgcacccctggggccatgagactgggaagcccgctagccctggggctgtggcttctcctgctttacttgttattatttttctgataatatctttaattgcaagattttgtgtacttttaggcatgtttcttgtaagtagcatatggttggatttgaccttggattgtgtttgctattgattatacccacaccagttcttatgttcctcatttgtaaaatgggtcaataaacttgacaccccctccaagagaatttgctggattgaagggcccagcctctggcctggcctgctggccctggacctacctacatctcgttgtctctggtgagcccagcatcacggggcagggacgagccctgccggccagggcaaagagtggagccgagggggctgaggaagcactaggcacactcaggaggccagtcctgaaggctctgcccacactgggcctcagtttcccccacagcatgtagctagctaggcctggagctgcttcagtctgggtccagtgacctctcaccatggcaggtgtccttgcctgttattgacctggtctgcctaccctgcccctgcagccaagatcaacaaggagcaggggccagggccagggcatcaggggctggtactcacttccctaggagattcaggacccctcaagggcagactgcccccaccagaagctgctgccaatctcctgccgcagcacctggagccctggaagggcacaggaaacaccatgggaattctggctgcccctgcacgtgtctgtgggcctgaggatggatggcgggtgggtgtacatgtgagaagcaagcgaggatcgggggacagatgggtggggggcggggggagtgagtcagtggtggagggccaggagtggggagcaggcgtgggaggggtgccctgaccctctgtggtgtggggatgacataggcccgccacccccgcctggagctatttctggccttggtgcactgagctgtggcctcctgttctgcctcataactgtggtctgtgacgtgaccgcctcacggggacatggctggtgtccgagaggatcctgagctgactgatgtcccggctgtgctacagctggtcccacccccagccccagccctctgcagcctcttaccccagccctgggaagcagcagctcagagcctccctggagattcccctcccggccacccatgacacaggagggcgctgcctgcccctctgcacgtggcctgcagcccagcccctccacaccctcccccattactagccaggccgccagccttcctgcttgggcaggacatgcctcgtggcccctccgggcagcactgtgagtgtctcccttggccgcctctccacctgggtagtctggagtgggagcagggcagggcttaaccactcactgcctcagtttcctaatctgtaaatgtattgctgtctcactttttatagcaggtgatgggaccctccggtgatcccagcccaggggcggcattggggcccgagggcaccaagctgtgcgtggatgaaagccggtgctcggcgcctccacagctgcctgccctgtgctgcctcctggcatcgctgggcagaggcaaaggcatccctgtggaacttcagcccaagcttgggagggcacggaggtgggcggggccccaggaacagtgggggccagggaccacatgaagaaggccatccctgctcggctcggctcagctccctgggctgctggggtgagctgctgacctcagcagccgcctgcctgcccaatggctgggcatatccccagagcctcccaccgccacctccccatcccccttctccacccctcccctctgctcctgccctcctcgctctcctcccacctcctcctccccccgccacactccctcctgcagtgaacgtgaacagccctccactcaccagaactgatggtgcaggtgcccacctgggctgcctgttgctcccgtcagggggatgcgtcctggactgtttgctgcccagcctcctgggccttcagcctggtgatcctgggtcctaccctgcccagtctggctgccgcagggagaggctctgggtcagtatccggtcactgtccccgctgggaaagctcagagccttccaggcaggagagccagccctcccctgactgtggctcctgagccaggcctgggctgagacaggagctcctagctatgacccagccctgacagccagcagggccatcctccggggaggtcccaggaggagaccctggaggaaagaagagatgttaattggcctgggagggtgggagaggcacagatgtaccagtttgtgtgcagcttggaggctgaggagagccctctggggccctcgcaggctcaggtggccgcagggccaacctgggtggggacggtggacaggcacgctatccgtggtttctctgtgagagctggggccatggcagggctggttgctcaccccgtgtgcaaggggcaggaaggacagagctcatactggaggctccgtgagaactggggccagggtgagactgggtgagagtggaaagtggggtgatggcaggcagggaggccaggctatctccagaaggacagtagagcatcctattagagttggccaggcagatagaggagagagaaaggtgggcgagagggccagagaggccttgtggccttgaggctgcagagcccaggggacaggtcaggggccacgggccagggaggtcttttggggtggggaggggctgcagtccaccatggggccagggaggaggctggtgagtcaccagtctggcccctgggatggggtcagaggacaccctccccccacctggctgcgtctccctcatcccagggccccggctgtgaagacaaacccatgctgcaaagttgggtttgattatctcataaaaagatgccccctcctgctcgctcagcagaggggttgccatggagaccagcgggcaggccccaaggggggccaggctggagccaattaccatggctgcagcgaggagagagcccacctcacccgactctcagaagttggtttacgaaaagcagttgtctcggcaggaaccgagccgtgtctttgcgcccaatacccacttcctggcagaactgagcgccacgtggccactcccccatgtcctcccctgtctcccccgaccccgcaccaccgtgtggctcagttctggcacctcactgggggcatgtttagagtggacacacagctgcttcgggagggagatccatgagcacagggctcggttcaaggcgagtgagctgagccctgaccacagccagactcacagcccacagcttcgggcctggagccacaggacagtggtgggatggtggcatggctcagtggtaatgtggcgggcgtggccaccatgggtggctagtcttggtgggtgcagtcagccgcatggtatggttggtgacaaggctcagttggtgacccccacagtcagtggtgtggtgtggtcgataatgtggcagtgagtcctgaccctgccccatgagcatgtggggcctccaccccacctggccccaggacaggaagtgccatttacatagcacagttttccctctggtgacagcaggtgagacagcagtggggagctgacatggtcaggccccaccttcctaggaagagtgtgtagaaagagagcagagagggtgtccgcagtttaaacagaacacgaggccaggtgctttcctcacccagcccacccagggaggggcctccggacccccatccctgggctgccatctccctggtagccaacaaatggccctggggcagggggtttggcagaggaggcccccaggctgtggggagggggtctgaggacctatgaacctgagtctgggaggacgcacatgcccagcggtcactgcgcgtgctgggcttgctgggctctgcgtttagggcgactgcactgtctgcccaagtagagaggacccagtggggcaggggccccatgtgggtaggagggccccagggtcacagttctaggttggggaagctggcctgtggtccactccttcctcctgcccggctccaaccccagcacttagccggcctcatgtctgcagaatcctgctcttagccagctgccgtggaaggtgttagctgtcaacgcaggtgttagctgataactcaagtgttagctgataagccataaccttcccagggggattcacattttaatagactcactgctgaaggcagaaagaatcttcagcattccaaaggggtgggggctcaatggtggaatgagaggcaggaaagcttactccggagtgggtgaccccgctggtgagaccagctctggatgcggcaccccgggagggactactgcccatgtagggccttggtgaagccccaggtgtatctggccctgtaatggaggaggggttgcaggcacctggggctgggggagaacccactgggaggctatccctgctgatggcgtctgggtgggaggggtgcaggcagctggcactgcaggggttggctggggaggagtgaactcctcccagggaggagatggagcagagaatgaggccagggggcggaggcttcaggagggttcctgccaagtcaggaagtgcttgaaaggaggatgtgtggaggagggagcaggctgcctgggtggttgtgggacgcgactcctcctaagccctggacacacttgccctccacccccgccctcgggcatccaggcgcccgtttttgagatagacgtgcccagagggaccccagccccattgcagtgtttcctaggccctgtgggtggaacccccactgggaccccccggggactcctgcaatgcgggctctgtgttcactggagtcctgaggaggtacctgcagtcaccagtgtccattccaggaggccttcaagtgagtgcccctggtgacccagtgggctgctcctgggtgtggtatggggagtctgcagatgtggcttccagggtggagtgcatggctccaaggcatgttctagcccagcatcgtccatgaggcctgtgaagcagggatcccaacactgcgattcccgggggtggtggccacatcttggacccagccccaggtcctcctgagacccaatctccggggcccacctggctctagcaaaacctccagcttctccagtacccctgcccttcctgctaaccactctgtcttctgcccacagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaagctgtggcctctcaggctagggtgctgtgggcggtgagaagcaggggtgggtgctggacgggcagcctctcccccatcacaaggcccccagaggaagggagttgcctggcaccacaggtgggacagccttggccaagggcagctccaatgtcaggtgcccctggccccccagccgcacagatggagcatgcttggtggctgacgtcgttgagcctggctgatggagcacatgccaggtccatgggtctggacatagcagcccctgtggggacagttgctctcgggccccccaccccaatcaggctgcccgggcagcccccaggaggaggctgaggatgagggaccctgttcctacccctggtgggtggcaggagaggaaggccctgaaggagagtcgggcgggtcaggcctggcctcaaggcccagtgggggctgtatgcaccctcacaccgctgctggtggtcacactagaccccacatgcgtgtctggggcacccccacttacagcatgcccacaccccaaacataggccgtggtgggtctgcatgtccctgcacccatgtatgcatacacgcatgcacacacagcagggcagggaacacatgtccacacacatgcaggcaccgggggctcgagagcagcacacgcatccaggcaaaaatatgcacaggcagaaatatgcacaggcacgctttcccacggcctgggccgaagaggactcagaaacaaaagggaagggccacgtggccaggaagccttcccaggaaagggccccctccccgccagggcagtggctggggagggggagagggagaaaaacagtgacgtgggggagggtgtgggggagcgttgctggtgaagccagatggtcgtgggggcggccggggctccagaagcctggggggaggagaaggagggagaagaagcggggaggacgcgcttagcagccaaggccccagctcctccgcccgcttctctgtgcctgtgctgcggcccaaggctcagacccctcccatcaagcacagggcagagccaggatgcagtggtcctgtctggcctgtaccctcctcagggtcctcccacatgtcctgtctctcctgagagaccctgtgcctgtgcccacaggtgctgaggccccccgtgtggctgcgcacacctccacctgcagtttgcccctctgctcacctgagatccagggccggcagccttgccccaaggctgggggcagctcaggcagggcagccctgccggggtggggtgctgtttgcccagggctccctctgcagcccctctgggcccaggagacccttggcagccccagcagaggcctctccatggatggcctgatgtcaaaatgttgtgcagtctctgtcctgtgcctggagccctaccatcagcacccctggcacccccagtctctgtgaccccacagccaggcccaggattctgccaggctgtgcctgggcactggcataggcagggttttattcagtttttctcccaagtggcccctgtcatgcctgagaagaggcagctaaactgctggatctgggctagtgctctcagctgaggctgggggctccttgcagtcagagccaggaaaccgaagccacccatttccaaagagccttgagccccacctgagtgacccaactgcagtggatgctggcgccctcaatggcttgtggaaggacagcagatcct

SEQ ID NO: 14320 - DNA, 24056 bp, Human
gggtgaaaggcaaccctgagagtaggaaaaggccagggagacaggccgattccagcaggggagactggcccatctggagcgccagcacatgcctggggatttcctggcctcacctgcagacaccctcccctccctgagggttgggatgctcagagatcacagggactctcaacccactgctgggagtggcccctctcagacaggcatttttattatcaaatgagcaatgagagaggggagaggtgaggaactctatgagaaacatgcagtcttttatcacgtcatcagttttcagtgagaaaatccagaccttcttacttttacagagatagaattcagttctcagggacttgtgaagatgcagcatcatcaaatcattgtgtgtgtgtgtgtgtgtgtgtgtgtgtgtgtgtgtgtgtgttgtgttttccttatcatccaccttagaaaatattctccacattcccatgttaaaatattttttcctaaaatccatccatccacatgccaacatcctaaagacagtaatataggttcattgcagaggatttggaaaatacagaattgtgaccagaacaaactaaactgcatccataattttatcatcgaatttgatcaacattttggtgaatagccaccagtctgttttctatctttttagggaatataagttccaagaggcagggatgtcattcacttctgtgactcagtgctctgaatcaggcccagtgaagactgacgtgcagcctgtattggcagaatgaatgaataaatactacacacgcatattttgaattgaaataagttgtcagggtgcagcagagaataacagaaatagaattgcttggatgtgctgacctagatccaagctgctactggtaacgtactgtatctccttgaataagtcacttcacctctctgggcctgagctgcttcttcagtaaaataatccttgtagctaagatttgttgagcgctcactatgcacactgccatgagcccctatatgtgtatttctcatcatagctctatgagttacatacctgccatctccattttatgcatgagaaaataggcatggagaagttaagtggtttgcctaaagtcacacagcaaatttgtggagagctgggcttgaactcaggcatctgggcttttactctctccagtggaatgcctgggctgtgggatgagatgacttcacaggcctctcccagctccagagttgagagagagagaggagtggtgcagggaggtagtagggatgattatgctactggccaagttcaagaaagtcaattgtagaacaaggtccagctgattattacagagagcaaagttcttaactagaggacttcctcctggaatgtggagagtccacacgggcactagcagagcataatgaaagaccaggaattctctgctgttcaatcagtgctccatcactcagaggcagggctgcaagagctcctagtgtgtccccttcgccttcagggcctccctgtacagccacccacaggacagtgcaccagggtcaggcagggaagtaaataaaaaaaggaatctgataattcctgacagtgagcagcagctgatgcttttaatgggggaggaagactgggaatctcgcttgatgatgacctaggacttcagtcagcaggacactggcccctttcctccccctcccaggctgaaaccttgtgttttgccttatgtccatggtaaccaagtctcctttttggtgaggaggaatgggcttcagtaaacagatctatttgtgtgatcctgttactcatttgaagcaatgtccctccttttttccactgtggtctgtgtgtctgagtcagagagagcctacaacagggttctttgaattgatggctcactcccagccactcttgactgactgccagcttagcagggcgtagcttaccaacaaatctttttttttttttaaagccagactgattcatagaaactcctttaaaacacggtgaaaagaaaccgcccattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggctaaaatcgtgcctggcagtgaccgggttcttgttctaggatgtggagggagcagggactttgaaacaaactgggataggatcctgtttatggaggaaacaccacacaccttggaaatgacatcgggaactggccagatgtttttcacctcctccgttttgattccgattgcttcaggacttgaactgttactccgctcgctggttgttggttgggattttttgggtggtggtggatagataactggttttcagtttatttttgacattgcttttcctgcctgtttgcttccctattcacttctgtttaaatttaagtattttttttctcctcacaggatgggaagagggggattggtttgtttaaagaaaactgttggccgggcacggtggctcatgcctgtaatcctagcactttgggaggctgaggcgggcggatcacctgaggtcaggagttcaagacaagcctggccaacatggtgaaaccctgtctctactaaaatacaaaaagtagccaggcatgatggcaggtgcctgtaattctagctacttggtaggctgagacgggagaattgcttgaatccgggagatggtggttgcagtgaactgagattgcgccactacactccagcctgggcagctgagtgagactctgtctcaaaaaggaaaaaaaagaaaaagaaaaaaaatgaaaaaagaaaactgttagagagagaaagagagggaggcaaatggtgttttaaatgaaacgtgggaggggttcacttggtcgaagcaggagctgatgaggattccagatgccttctcttggccagatgtggagggcgggggaggcaaaagggaagctgggtttggagaagagggtggggcaggagaacttcatctgtgcctgttaaaaattgttgagtggctttgtgctttcaccccagaaagagctgcctttcagtgctgagtgaaaagatggcataccagaaacgataaaagaacttttaaaagaaagtggatgtggaatttctttgcatggaaggcagtgattgttttgaaatgcttatcttttctcttgttcccgaaatgtgattgtataaatgcaaacactcatgctaatcatgaaatctggaggaatgaagaagggtgctttttcttttttttctttttttctttttttcggttagcattttgggtgagtgtctaccgaggtgtggcccatttcaacatagacactggtatattttttccccaagtaaacaagatgagaatgacaggattcagcttgtctgacaaagttaggcttttcctttagaaaggcagtacgttgggagagaagttacatgtaatcaaccctgtgttgagcaggcaatgctccttgtaaaactgccccaagggggacgattgagtaggcatcagggcaacttttcaagatgaagggaactcctacatttgcttcacatgtttattatttccacattacatggatgtggattagccattattaaatcaatagtgttaatatcctgtgaaaattatacaaatcttttagttctgtgcaggttaaaactaataaccagtcaacacacggaaagccctgacaatgttgggagtgtaaaccatcatgaactgcattatttgtggcaaggtttcacatgatactataggtttataaaggagaaaatatgctacatgttacttcctggagtttgaagacaatttagaaaaataccgttctgattcctgctctctgctcttcctccaagaagtagtgaaagagtcccttagctgtgagagtttttctggatttcagctttgacaatcccgaaatgtgagggttatttttcccccccactctgcccgctgcctcccaccctcaggggcagatccaattccacccagactccgaagaatggggcgggggcgggggctgcaggacatcctgtctggcgccctggtcagagggccccccacatttacattgtttgtgggtactaaactgtcttgggagttggcaaaaggccatcaagaaccaacttggagcaaatcacatccttagaatctggctatctcccaggactgctgggcagaccgctggggaaaggaaagacatcccttctgtggagagtggaaaggactcactgcgccttcctcagcccttcctgcttcctccagagaccagattaggcccatcaagttcccagccttgtcagtgggcttcatggagacccctcacccgggaatgtagaccctcttggcttgctctgggtggctctagggatttcaggtagtgccagacccacagggactactggagagagacacgttgaagaccggggaaaacttgtggatgaggcaagactgcttttctgtagactctatggagcctggtggggcacataactgaaacgtggacacaggaaagggcaggaggcaagtcagttccatttcatccttcatttcgttcacagaattctaaatttgggagggatcttggatctcattcattctcctactgtatgcagaaatctaatttttacaccatcttgaacagatggccatcctacagatcttaaaatttccagatgcggggagctcagaacctcagtgtgtacctccacactcattccccttagcaggccaactctaattttattaaagttccttaaatcaagcaaaatcaacttccttataacttcctgattctgctggcctgaaacaactcagaaaatatctattctggttttgttgttgctccacccaatgattctcatcctctaaacacttaacgcctatttaatatttaatgaatacaacttgatggatctacattgcattatcttttcttcttcttcttcttcttctttttttttttttttttgcctaaggctcagaagggcagggagcatttttgaagtttggaattatgtacatagtcaatcatactcacggggtttttgatttggaggtatttaattttctaaatgcatgaatatggttccttctttaacctcccacatgtatgtacatagctgcctaacacaaaagctcaggcctatttgggactctcagatgtacatactcggagggacacacccagtgttgctacctactaggtcatggttagatcaatccaataccaggacacaggcttctagctaggccttttggggattgtcccataatttggtccatagttcatgtagcccacacctatacattgtcaccacccatcatagtaattacgggaacaggctgcccatcaaatgtagcctccttgtaattgctggccagcaatctgggtatcagccccttgagaagagctcctaacccttaaccagcgtagaacgggaattttctcaccataagcttcccttttctaatactcttcccagatccgcccaggtgatcttgaatttctggactgcacttgctattcagtaatcaaggaagcccaaatatggttccagttaggggtttacttgaatcttcagcacccagccccgacatacacacgtcctgagactgctctttgcaacaattcagtccctggtgtcctgcctgggtaaaaccatttccttcaatttacctgggagattcactgatactaaagcagaaagatgaaagcacaaacacctgtggtgattgctgcttctctcttcctttttaacaaaatgtttgggtcaaggttttcttttgtgttgtggagatggcatttccctggaactgcaatggaatcctctgctgttggtgcgcttggacttacgtggctgtgacagtttttctatttgctgagcctgtttcatgaattgtttcttcaaaccgggtagttaaactagagagccctttcagcacaggttgaaagcgtggcaagaatcctggagcagatgtaagacagctgactaggaagacagaggggcagtggtgttatcttgacgctgccatgtaaccacaggcgaggcacttttcttcttgctttcggaagttgaacttggtggttctttcagaccccttatggctctgagattctaagattcacccaggcgtggtaatcccagctacttgggagactgaggtgggaggatcacttgaacctaggagtttgagaccagtctgggcaacatagtgagaccctgtctctaaaagaagaattttaaaaagcagggtgtggtagtgcatgcctgtagtcccagctacttgggaagctgaggcaggaggattgattgagccccagggctttgaggctgtagtcagctatgattgtaccattgcactccagcctgagcaatgaaacaacaccctgtctcaaaaaaaacaaaaacaaaacaaaccaacaaacaaaaacaccaaaaaaacgaaaaacaaaaaaattaagatcctaccatttctattttgagatatcccttgcgctgatgctagcagctggcttaatctgtaaaaattgatagaaaagtgaaatagggcaacgtgtggcattgaaaagggcattttgcagaggattctcgtctcctgggtgccttgaggacccacggagcctcctctgccccatccactcacagattctttaggtatggtgttccccggacttaccctcagccatgagcattcactcggcactaggaataaaagaaagaggtttgagtaattaaacgtaaagggtgccagctcagatgaggagggcaggctgagtctgtgaagacattgacaacagcaaagcattcaccaggaacagaatcaggctcagggagaaactgagctggctctgggaaagaaactccaccctcttcttgaggagggagaccctgcagcatgaaggtgtggtgtacaggtgtggacaggagcaaatgaggaacagtttgagaggaggaagaggaaggtgcaactaggacaggagggagggagggagggcaagtgggatgctgtttcccaggcctgtgtgttgagggaggaggcaggcagaaagacctagaagcaggagaaaaagctaagtggatagagaaagacagaaagggggcaaaagagcaagggagaagtgatgaggatgtttccccttccatccttccactcttgtttggggaccacccaccctcaatgtttcaaggcagtccttcggtcaaaattcgattctttgtcccctgtgaagaatcttttgtcgcattggctacttcttgttttttcaggatggttgacacctctttggtatcattttagtttccactacatgtgcccaccaggctggaacctcttcaatgtttctcctcttccaggtcagatcagagctgagagcaaaacggggttcttgatccttagacttctcatttcaaagaatcaaagacccttccccaggacgctggagaaggggagttggacagaggtttgcaaccctgaaacaactagtttggggcaaggcagtgtgttcacattgatctcagagaaagctctgaagctgagacctggagcttccctttattgaaagatagtctccatgtctgggtggggtggggactcctgtgctgagggttagaaggttgctcggagtttgcagggggatattgttcgggtctgttttggccaggcaggctggctctgctgggtgggacttctcagcaaaacgacagggagaagcagtggcctcggaagaccctgtgtttttataattggcacagttttaaggggtatatgctgactctctgattaactcagagagggtaggaggaaaagagagaacagtagatctggtagaagttctagaacttccaccaaaccctaagccaagagacaggagagaaaaaatcatgccaggtggaagagccctgcctggaaggtgcgaaatggcttcagttctgattcaattccatttctcctttggggacgtgcatttccttcttatcaaggggttggactgaatgacctcaatgcctctcaacctctaaagaacgaattgaaatgaagccctgagcccacctgatgggtctggggtgtctctaggcgaggggcctcccctcccagcttgccgccttccaggaggctgcagctttgctggttgaagcatgttgccgccatctactgttggtcccacccaagcgccgctggggccgggccacacctaggttttcttcccaaacccctagttattatcttggcaacctctcccttgaagacattctggctgccagaacactcgtttgtcaaaagcagaaggcaactcacgcttccgtcctcgcccagggaacatcgcctgatcccttgaccagctgcagtctgggggagtaggctgggccccaacttcacagcccaggtctggcctcagtctttgcagatgttgcccagatccacccctcccctggacacgaaggaggacaagcggaaataagagagagaggttattcttcttgggagcatttgcaaaaacaatattcatgccacttgtttgcctttagcataattgttggccctcaggctctgccagagaagcataaagcccatttccccggcccgagcctctcattttacacagaggaagagaccaaccaaccaggaactgtgtggcccccactctgtgcctggcacaggccttcagccctcatgctaatcctgtgaggtctacaggtcacagttcagacatggtggagccaggattggagctgagaatccctgctctgtgctactttgaactctgtgcctgtaggagccactgaccagagaggttatgtgatttttctaaagtcagaagttggtcaggggcagatttattataagaatctggttctccaataggttctctctctctcatacagtgtgcttgccccactcccaacccacaccttggctcctcacccctgactatgtgagactctgtgctagtctacacagcaccagaccaacacgacttgctgtataataacccccatttataatagcctgcatttggaagatgaaaaaaataattgttttccctgcagcatgtaggtccctgttacttttgctgcttgattgacgatgtttctcctggttgtaaaaactgccctgtattttccaacatcaagtcctacctgaggttccttccttccacaccaaacatgagctatgcagaggccggaggaaatggcccctgagaatcctttttctccccatgtttcccacggagaaattaatcccctgctttcccacccctgcataaacacaatattgagaatggaaaagtacacttgatataaaacaacaataacaatggccagagaggctcatccaaggtctcatccactcagcctgcctttaatcccagtcttttcctcctccagacacatcctctccggctgcccccagaagggagtgcttccttttctgcttttgtgttacatgcgcatccattttgccaaccaaatgatccttcatgggaaacaaacacatcaaaaccaaaccaacaaaagcaaaatgctcccgacttgcgcagaggacagaaaggctttcgtgccaccctgcgtggtgtcttaggaaggagaggcagctgcggagtttcaggtgtcacgctgaggaaggtggtgtggggtcgtctgactcatgggggtcagttgaccagaagcggctacgcctctctctctcctcgtgctttggaggaagcaccacgtctttggtcagatgctgtgagaaagctttctccaaagtttacagttatccagaaagagatcagaatctcactgtcagaaaaacactggccagcaaaaagacagggagtgtctagcagtaatctcaggactgtgttatgacttgactgagattttgagatctaaggtgaaggcctctggtgaatcttctgataacctggtagttctgctgtgaagacaaccatgctagaaagaggaagaattagtctagtcaggtaatctcaccggcagaattaaaagtcatggtggtcgttgcaaagagcacactcggacgtattgtcagaaaaatctttctaatcggggaagggatcctggtaggtagtgagctctccatgactggaggaggttaagcatgattcagatagttctttggtcagatttgtagatgactttcttgaattgaaaaggaattttaaagacctccctcttcagtcctgagattctataattcaaagaagtagagagaaagattaaatctgcagacaaactagtgtttagaaatttaaggcattttctttgcattcacttatttcctcttgaacaaaaggcaacacacacatatatacccttgtatattcaaatgcactcaggaaacagtcacatatttacataggtatttatatagaaatatataacaaagtttgcatacaataagatgctcaatacatagttgtagtaaagtattaagcaatttctgaaaaataataaaggactaaagtctatgtatgttaaaaaaaaaaggaaatattttccctctataattctgtgtttattatgaagtcttcagtcattttgacattgattatttttccatggggaagaaaatatggccatccttaattcatttatttgttcattgaacagatatttatttggtacctgtcacaggcaagactctcccttcagggacttaaaatcttagggctgtcatcagtggttttaataaaaagctatgtgagggcaatagaagaagagagaaaagaaaactgctcctaacctatggatctgggaaggctttttagaagaggtaggattttagcttggttgaaaagaatttgatagactgtcactgaaagaagaatacaaaagcagagcttttatttttggaaatccaagtcctgggattgcaagggctggcttgaggtgcgtggagcctctttcctgctgattggtggtggttagaggtgggggtttggaggttcttgagcaggggagtgccatggtcagataacccagtagcagggtagaagatatgttagaggggagttgttcagagacagggtcatgggtgaggctgatgccatggtcaggctaggacctgaactggacagtagcaatgggaatagaacataaggaaggatgtgagataagtaatggaggtagaaactcagggtaggactgtgatgttttgggcaacaaaagtggaatgaggggaagggaagataggacatttggcagtggtcattactgctcttttctccccagaaaaatcctggcctttcttaagctgccagggaaatgccagccagatccataccctgcttctcagaaagctctctcgtgcccttttgtagagaaggtctccatgatgcctttcattctgggagaatctcacccactctcaaatgaatcatggaaatttgagccctgagggcctcccccagtgtttgcatcgtcttcagctcctgatttctgagcatgctcccctcccacccctcagctagggctaattcttcagtgactcaagccccaggattttgaccacttccttcactggggaagtgggtttttggttgctctattctattgtgttgctcccagttattgtgttttaggtcactcttaaagaattgctgctgccgccaggccccatggcagttcagtgaacacacagacttctggacaggaagaagttatctgactcctaggttagcaatcagggaaccaaattatgcacctctaaacttcccttctggtccttagaagtcaattcttctcaaagtctctgcagatttagttacccaccagaaaaggaaaggctcccatgggggcctgagtaatttctcactggtcagagaaccctaaaagtgttaggctgcctgaacaaaggcaacaaggcaatgcatggcagtctcagggctgtgttcctttgattctttcatttgtgtgtgtgtgtgtgtgtgtgtgtgtgtggtgtgtaagagggaggcaagaagccaataaagatttaaatggatggagataacttgagaggtttggttatccctctttcccttccctcatgtctcatattagttagtcctttagagctatagtcacgagcaattttaatcctcagggttctattttattttattttgagacggagtcttgctctgttgcccaggctggagtgcaatggagcgatcttggctttttgcaacctccgcctccctggttcaagtgattctcctgcctcagcctccccagtagctgggactacaggtgtgcaccaccacgcccggctaatttcttgtatttttaattgatactaggtttcaccacgttagccaggatgatctcgaactccctcagggttatttctactgactatattagctattctgttagctaagaactttatctgaatactgaatggtcagtgtttgtgaggtttgcattagagctaggagcacaaagacacctctgctctagtgtggtctgggcaatgcagaaagaaaaggaggaacagtgatcagaaacaaaagatggtggtcagaggtagggaactgcaagcctgtccgttagggcagaaagaagaacagaaaagggatatcagagacctgtgtgtggctccgaggtgctgatctccatttctcttaataatacttctctccagagtcaacatacatgggtcctataccttcctcagtttcccacccagcccctaactgcccctgtgccatgtatgttaggtagatgaggcttaagaaggagatcatcctccactcacagtggtgggtacagaaatgtgttcctggcatccacatagaagtcagtggatggcctgttctttaaaaatgcaatgaattgataagctctgctggcctaggtctgggagtctaagcaccacaaatgaacgctgttatgagcgttcccctacaactttggaactgctcagtgcaccaaatgctctgcaaaaagcgggtcttgcttcaaagtattcagaattgcaatgctgtgattctctgcatcttggtttgcgctgcctcactaggactaggggtatgctttccactggagagtgccacccatatcattttagagagggctgagggagaagtctactattgttttagtgaaacacactgctaagaaataagtagtagccaccaatacttccaatggtataaattctcataaatggtatttttttcagtgcctttgtatgaagcaagattcacaatggggcagagaatgaatctccccacaagctaccttgcaagtaatgggtgggtggaagtttcaggagcaggggttcttctgtttattatactctgctatttgataaatgcccagacatttacccattagttaccgctaatggctttttcataaagacctcagtgatcacctcctcccagactgagggtttccctgggggcaggaggtatctagcacagtgtaaagactgggtaactagggatgattcagcccagaaactcaagaagataactcattctgttttcacctgtgttggggggaaggccattgaaaataatggaagcccctctaaactgacagtgaatgatattagtaaaacctgacaaataatgggccagtgaaaagatggagaagttgtagcttaagctaaacagcccctccttctggctggatacagcagctaaaaacagagagaactgtgtgttttgcacaagaccgcttgctaactcaagacattttgcttctttccgtggtgaaaagacagggagggcaccatcacaaaaatctaagatgaaagagagtcgctcttttgcttgattctcacatccattcttccagcctgcaatgggcagggcatatggtcaggtggatccaggggccaggcactcgcacacaccaccagggctgtgatgcatgggcccaggtagaggtgccgtgggaggggtcattgagacagagagtgtgagctgggcagaggaaatcagacttgactttaggggttacagagcaacccaaggagacaaaatgctgctgaattcccaacagcctatcagggagggaatgttttctgtgactcatttaagtggcctcacttggtggattatattctgtcattggcccctccagcccttcccccttttaagaagaggatgtttgtaaattagaagcaacaggaacaagaaagtcatttgaagagcccgaggaggattaaacataagtattcgttatgtaatatttgtaattccctgcaatcagcctgttcctttccccatagggggcaaggagatcaggatctggtgaggtgtgaatcttgggaggtatgaggaagttgggctgagaaagtgaactttctcctggtctttcctgagggtgtgctcttagaggtctccccccttaaggggcaagggttagacaaatgacaatttctaagaggaccgaaaggattgtatacaccctgcctcgtgaactagacagcagatatcttattacttgcacttaacatggggcagcctagcgattgagtaactgggttgggttggcaacagctacccggcttcacttatgaataatagtaataataataaccgcagctaaagcaaccccattattagtagctgccatgtgtcagacactaggtgttttacataaacaatctgaattcatcctcacatttccctttgcaattgacattgcgacttccactttctaaatgaggaaacagatgagcggtcaaataactggatatgattctaattcatcctctgtctgattcaaaaatctctttttactgtgcatttaagtcaagcagaaaattggggaggtgtgctagaacctgagaaaagcaaaaatgaatttgaatgtgtggggggattactaatagcagacatgaaagctccaacctctcccctgaagaggcaggataaacgtcataatttttgcattcacagttaagttggacacattcctaaaaaacagcctgggttggaaggaagtggccagattgggaaggggctgttggagacggtcagggagaatggtggaagccattgtctgcctctcattccttgcttgcagagagcaaggcaccctgatgtatattagatcactctagatttttggttgcctgataaagacagtgagaggagataaaaggcatgtgaagtgttggaattatagtatcagtgctctctaataaatacctgatgtggcatgaaagtgcctcaagcacattcaaagcatcaattaaattaggtggagtgagagagggcagtggaacaattgcaggatgcgcctggccatctcctcccttggttggggcatccacacatccattctgtctagggtgtgaataacctcaagccctttccttttgatgtccctctgagcctgcactgctttgtgacagtcttaggcatgacaaagctctccttctgtagctgacataaatcagaatagcctcccccatgtgtatccttcacacttcctttatttcctaggctttatgatcaatgggctcccttctctgctgtgattatggctgaaagcttttgtttatccatgcacattcttaatcgatattagttcccaatcctcccaccctgtgatttatgcatttgcctgtcttctgtattgagtcctgaaggattggaatttgtgtaaatgtcatgtacaaggagaaggcacatttggtgctatctcaagttgcattacttttaaagcccccagaaccatcacattgagctgtggaaaatatgactctctgcccagaccaatggcaggcttcctgccatgaggcacacagagcccaaaggctcaggtgtagtaatactagtctgaaatgctcagtcacagggtgaccagaccattaaactgtaattaggttgttataattattgaaaaccaaacagcattataataatagaattgtgcctctcacattttatatctcgcccaggatcatattagtagcctattcagtatatgggcattgagtaatagctgctattcttcagaaggcatttacttctattaaaagtgctgggtgagcaatttgatgaaagcatggacattttcctagtggaaaatggacatttatatgacattgttcagagacctggaaattataaaggcctacttctttgaaaatcaaagtcctatttttaacctctaaaacacaaacaaaataaaatacgaacagttatcataaaatgttcttgttccttttttgaaatagaatgtattagagaaatgagtatgtaaatacccaagaagaaaccaaattctgtttccatgtaggtatgtataactggatgaataggcacttaggcaaatcagaactaggttacaggggtgttttcaggaatttatgattagattgtgatggtttttagtgcagctcttcctcatgttagcagatagcccacacgtgtgggaaagctgagtcgtcttattgaatctgacagtaaccgtttttgtccctttctttttcttttcagaactctctttgctcacaagttaccaaaaaaaaaagagccaacatgttggtattgctggctggtatctttgtggtccacatcgctactgttattatgctatttgttagcaccattgccaatgtgagtaatgttcttttgttcattcattcattgagaaatcattcgaatatttacatcaagtgcacaaaagaagtttaagccacagcccttgcccttcatgaacttacagctcagttgtgggaaaacaaaataaacacacgcttgcccttcaaacaattaaataacaggaggataaaagtgaatgtccacaggagtaatcctgccagagctgtaggtggttaagggctggaggatctagtgcagcttcttcggtctctagaagagccttcccagcagcaggggtgagtggagcttgaggtgaacctggaggagtggtagatggctgaggtttctcttagtgaaagagggaaggtggaaggatcatagggatgcattcaggtgggagtgctagcaaaggagcatatgtaggaaggacaagctttggtcagaggataaggaggacacacacctatgtggctggagccgaacttcccctccttctgagaagcttgattagaaggatagatgggaagaagaggatgccagactgacaaattcaaattttgagcaaagagtagcatgtgaaagtggagttttgcaagattaacccagtgccactgaattaactaactcagacaaaacgagaaaaaaaaaatggaggtagtgtcttttctctctgaaccctgggctactctgacctctagtggtggcttacagcgcccaatttgcttttacttgtgcttttctcagaaaaaagccagctccttggacctaaaaaccaaggccaccaatcactaggcaggcaaaccatggtttcagaatctgtttaggtccctatcacagttaaagtataagtgagttttaaagttcagatagaagagctttgcaaacattagtgggtgtgatcataagcaaggctaattaagaataactgtgataagacaacccccgcccacgtgacctccttgttttgtaatttagccattctatatgtcaactcctatatctatccagataaatctgataagcttcttcaaagtgtattaatgagcgccaaagcgctgcgtatctgtgaattaccagcccctaatataaggctaggcacacagttgtttattgaatgaagagcagggattggcgtaggtgatgcatgttcccggccccacctttccagtgtgtgcatttgtgtgtgtgtagacaggacactgcacttgttttctcttccagaaggataattccttttcttgggccaggcaggaagggatggcggcaccatgatcagtctgggggaatccattcaggtcacccttcagcttttagtagcccctacaggaaagcacttgctgtagtattttactatcaaattactttgcatgttgtgacagtcaagtttgatccttctgtttagatgaaagtggcttattaaccactagattcattgttattttcccagtaggtcttatgtttcttaattgtttccagttggacatttcacttttttcctggttaaccagggacttaaatgaaacaatcttgttagagtatatgaactgcacatacctaagccagtttcctcatcctggacttctgtttctcagaaccttagaattttaaaccactgtggttgagttacttccatttttgttaagtcgtgaagaatgtggagcccaaagagggctaggtgatttctttctgggtttcacattcttctgtgtctcttctcttggcaactttgtgaacttcagttttaatcggaccttatttccgcccacagataagctgcatagccatagttatagctaaatagaatgtctttattaaaatctgatcccgatgcaagctgatttgttattttatttttaaatcagagggccagctttcaattaacattttctttccttctggtttcaggtctggttggtttccaatacggtagatgcatcagtaggtctttggaaaaactgtaccaacattagctgcagtgacagcctgtcatatgccagtgaaggtatatataaagatattgacccagtgctgacaataggtgtggtcagggaatgttcagcccctggagtgacctcatgcccttgttctcctcgtcctgtgtctacagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtggagaaccttggattgctgcttaggttaagaaccctcatctgcttcattgttcaaaaccagtgctcctgggtagctaccaagtggcagtgcatatctgttagtagcacgtgtgtacaagacacttcaagaaggcagaaaggtaggagttctcagaaagatgaaaccactgccacaatgcacatcattattgtgattctcacttaattgttgttctttcccaatatactcggtttggtggaaggacatgctcttttgcatccctgagtagctttcctagacccacaagggccagacaggacagctgggtggtaggcatgaggttctgtgttttacatcacagcgtggccacacaaaccagtgcagacatgagagcccagacacctctaatttatcaacataccgtcgagcttggcccaggggacatccatcagaactcctgtttagggacaaacaagcagaattcattttcctattgctaatgagggaaataggatcttcttaaaattagtaaaactttttctcgactttaatgtaagaaaacacaccgacaaatctccttttcccctgcagggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatgtggagaaatatggataattatgacatttatccctcattaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagcccattcattacataaaccagggcatacctgtgtgggctctgtgagtgaagggaggcttcactactttctgtgagcagtaaggactggtatctttctgtgagcaataaggactggataaagactgcatatccttgtgtcgtgtcagcaccaatacaataaggagggttttaatgtgaagcaggcaatcttccagccccttctggtcttggatgaaatagttgcacagagtattgcaccaaaaatacacaatggaggctgaaaagttcaacatattttaagtcaattaatcaaattgcattgattcttgatgctttcttagaggcctacatgatttcttagattgctctgataaactatcataaggggtccacctcccctcatttagctcccccagggatttcttttcccccatgtcatacacccagtcctaaatcaacccccaaggctatccttccatcccttctgcagagggaacttttgtcagactctgcaacaaactcctagctctatccagagtgtcctctgctgctaagattggtatctttctcctcaaaagcctggatggtgaatgggggtgcattagtcagaattctccagagaaacagaaaaaataagattcgcgtgtgtgtgcaaacatatatataaataaataaaaatatatttattttaaggaattgactcacatgattttgaaggcaggcaagcccaaagtctgcaaggggtgggccagcagagagctggtgctacagtgcgggtctgaaagttgccagagtcccttttatagagaagcttaaaaaatatttgttgaattaaatgtcttaggtagagacaaattgaattaaagtggttaagtaaatactcttaggtgaaatttgtgcaaattatgagtataaagagggtgagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggctttcaggcatggaaaaaaatttcacaaaggcctgaaagaaggcatatgaagaccaaaaggatattgagcagggttccatacttgaataaaaggaagaaactcccttcaatgtttactaagaaatagttagaatatagcatatcctgtatagatgaaatgtcctagcgaaaatgtttaaatgtatttaaagaagagctagattttgtggggggagagaagggaataggataggctggtgggaggaagaatgaaaagaagaaaacttgttggaaattttggagtagattgtgaggaggggtgactcactttaaagatgtatcatttggaggtagacacgattttcagagcacaaaacagataaggaaagatgtatgctgattgtgtggagcccaagggaaggcgggtttttggagtcttacgtggctttgtttctgaaagggagacatgtgaagcctactcctgaggcgggaggctggggacatgaccatcaagacctataattgataaacaactaggggctgggtgctgcacctac

SEQ ID NO: 14321 - DNA, 150032 bp, Human
aggggcctgtgaaagtgaaggttaactttcttttctttttttttttttttctgagacgcaatcttgctctgttgcccaggctggagtgtaatgacgcgatatcggctcactgcaacctgcgcctcctggattcaagccattctcctgcctctgcctcctgagcagctgggatgacaggcgtgtgccaccatgcccggctaattttttttgtatttttagtagagacgggggtttcaccatgttggaccaggctggtctcgaactcctgacctcgtgatctgtccgcctcggcctcccaaagtgctgggattacaggcctgagccacccgcccccggcccagtttcctgctttgaggaagccagaatacaaaactcacttggttcttagaagcaggtcatttaaataaacggtgactagacctcaggtgaatttgggagaaagtgatttggctgtttctgctgtccatctacttacaaacctgcagcacctttggttcagcgcgcatttcttggaaggagcggagtggcttaagtcagagacctggattgggctgaggtactgctattcattacttgagtggccctgggtaagtcattaacctctcaggttctcattttgctcctctgtgcaataaagaataagtaacaaaacctgcctttccccagggtagttttgagtgtcaaatatgataacttgtgttcaagcactagtgaactccaatgtcactgaggtacttgttaacattgtggtagcagctccactttcttgcccatctgcctccaggtaagggcgtgtgacagctgggcaggatgcatctgatggctccattagggttaactgttggagcgcctctgcccagacgaaagcctggcaggtgatttcagggggcgtctgggccattactcctgaatgcccaatgcactgggagtagcagaggctgtgcacagtctgagattctagggaatcttttccttctcaagctgagaattgataatcgaagcatgccaaacattcgttattatatgcaacttgtaaaatcctaaatagtcttgtccaattgtccctttgctcttaggttttgaggcatttatcttggaattttatctgccagtttagaaatctttagctggtcgggcttaattctgggggcagtttgtatttctgggaaggcgggagaaaaatgacaatctcagttttgaattggcgttttaatatcgttcaccagatccacgctgaaagccggtgtaaacagcgttcaaaaattccgccctcccaaaaaaaggatgctgaaaccgatttccaaccccgaagacggagctcatcaccccgcaacgggatccgccgtggctccccgcgcgtgcaccgcggctgggcagtctcaggtggctgggggcgcgagaccggagccccacctggccctgccggcggcggccgcacaaagagcgaggcagacggctgcccggccgagccgcagaaagtagtcccgaccacgccggctccaatgttgttcgacgccgcctcacgccctccgcggggagggccgaagcggccggtccgggaaagaatcccgctggaatgcgccaccgggaggaggctttccctcccagttcgcctctgctagcccagaacctctcccagggtctcaggcagaggctgtgcgtgcggttgccgactcccttccctggccgtacaggaggcagtaccgggagaaggggctcgttgcgcgcagggacacggtcgcggcgaccctaggaggcggtgccgaccgtatccctgcgccgctgcgcgaggcagaggctgaatgaggagctgcgcgggggaagcggggcgccgggggaggaggcggcgggatggaagcagacgctggcgtcgcgcgagcccggggccgagcggcgcggtagagagggcggcggcggcgcgcgcggaaccttgacgtgcccctttctttcttctctcgctgggaagctgggaagtatgagcgtgcagccctgccgctgcggcggccgccccggctcctcgcctcccccacttctggccacccctcgccggtgagagaagagaacgcgagaagggaagatgggggccgtcctgaggagcctcctggcctgcagcttctgtgtgctcctgagaggtgggaagagtgggggcactggaaagttggtggggttcggggggaggtggccttgttgtatgtgtctagggggaggggagggacggaggaagggagaaggggagaggagcggggagaggcctggtcgtggggagggggagagaaaggggcccgggagcaggggctgcgtgcaccgcccggccacaatgcggacctggcctggcttcccagaccttccccggacacatcggagcttcgatcccggctgctggtcttagggaacccttggcaccccatgctgtcgggatgactgagtgtctgtgtgcctctctctgcctggggtcttccagggaaaagggtctttgtacgtattttggcttttaaaatgtttgagtccgagatgctttaaggttggccttatccatcgaagccccgccacccactccccaccccgtttcggtgtttcttaggtgaacttttaaagccctcttgctattttttccaggccttgttacaggtaatgattggcttccgtttgggatataatgaccctgggtgagagcgcagttggaaagtgactccggggttataggtcgagcgtttcagcattgggagccttctgagcttcagcccataataaaataaaacattgcccttgtaacctctggtattcacggcttgcccctattttcggagtatgcaagtgtacagttggcactaagtagggaaattcatcctcgtgtgaagaggagccggtcctgggaccaaaatgataatttgctctgcacccctggggactgcttggcactttggtaaattgcataggctgttcgagataatttgctctgggaatcgcttgaattcgatggcactatgatgttttgaattggactgcaaagctgacacatgctctgtgacttttgtgacagttcacaaagatttttgactggcccgtcggcagctcttctcaaactatttagtgttgaacttgagatggctgtgatggctgtggagcatttaccagcagaggaatttaagtactgctcgatacggtggcttgtagttttggtttggtaaagttcttactggcgttcatagtaagttcttttcaggcatgtgaccgctggtcgctggagatttttaggtgttaacaagctaaacttttgttaagttctccaaactaatttaagtttacagaacactaatagtaactaatagtctgtgacaggtgtatatttttgcgtgtactgtgtatatgtatttcggatgagaatgattgagtttttttttggaggaggagaaatactttcttcagttactctgtagtaatgcagcattgtgtttgcatgttatattacttgatactctaagcatattacaaagttttcccacatgtaaaccccggaaaggtagtgttcattagatttttgtggcagaaattttaatgaagtgttacgtactggagaggtttcataagtatatacttattttattattggcatactctattgaaaggggttttgctgtagctgttagaaacaactatatttgacataagaatatgtatgtattttaagacataaggttaatagggctgacaaatatgagaaccagctgattggttagagtcgtgggaaaacttataacttgggatgtttctggttgtctagttgtatttcttggaggagaagcgtgtgatgtaaatgccgtttgtttaacaccagctttgagaccagagctgggtttgttcattattggaatttagataggttgcacttatttatgtaacaagacctggaagaggtaatagtttaaattgtctcgtttccactagcaaagttttcagaagtggagctctcgttttaaatgtggcgaaatatggtgtaaggtggtcttctaatatgtaacagtactgtacttagctgtgagtacatattatttgaagtaaaactgtcttttgatgtaaaatatttttgttcataatttagaattaattcattctttgagaatgtcatcctctgttatagtaaagatatttagtcaaccttggactccaaggagaaaaatctgattgatttgttgcatttaggtcatttttttcccccacaaagaattggggctttaacattggctgggtgtgatggggtatgtgagagtctgggagaccttctgtcctgtagccctgttgaattagtagcagaaagccagggaatactgttagtgctgtgtccctatctctatcatcacatgacaaggtataaaggaaagatttgggaatttcaatactaaaatcttggatttaaagcccaagtgtcacaacttcataactttgtggttctggtctagtccgcttctctaggtctcagtttctttactggtagtgtggataatgatacctgactagtttgcagggttattgggtgttttaaatgaaataatatggagtaccttgttaatgttactttttgctataatttttgcttgttcagggacatatcctcaaatgctttcatgatttgagatttaatttgtataacgttcacaatttttttttttttaaagagacaaagtcttgcttcatcactcagtctggggtgcagtggtgtaatcacagctcattgcagtctcaaagtcttgggcttaagtgatcctcctgcttcatcctcccaaagctctgaactataggcacgtgccactatgcccccaattttttgtagatatggggttggtgtgggggtgtcttgatatgttgcccaggctggtctccaactcctggcctcaagtgatcctctcaaagtgctgggattacaggttacaggtgtgagccaccatgcttggccaggttcacgaattcctattttttttttggaggtagggtcttgctctgttgcctaggctggagtgcagtggcatgatcgctgctcactgcagcctggacctcctgtgttcatgtgatcttcccacctcagcctcccaagtagctgggaccacagttgtgtgccataacacttggctaatttttatagagccagagttttgctatgttgcccaggatggtcttaaactcctgggctcaagtgatcctcccacctccgcctctcggagttctgggattacaggtgcagattcacacattctttttttttttttttgagacggattcttgctctgttgcccaggctggagtgcattggtgtgatctccgctcactgcaagctctgcctgccgggttcacgcctttctcctgcctcagcctcctgagtagctgggactcatttttttgtattttttagtagagacggggtttcactgtgttagccaggatggtctccatctcctgacctcgtgatccgcccacctcggcctcccaaagtcctggaattacaggcgtgagccaccacgcccggccagattcacacattctttttttttttttaaagacagagtttcgctcttgttgctcaggctagagtgcaatggcatgatctcggctcactgcaacctccgcctcccgggttcaagcgatactcctacctcaacctcctgagtagctggaattacaggcatgcaccaccatgcccagctaatttttttttttttttttgtatttttagtagagatggggtttctccttgttggtcaggctggtctcgaactcccgacctcaggtgatctgcccatctcggcctcccaaagtgctgggattacaggtgtgagccaccacgcctggcccagattcacacattcttaaaagtgaaagggatcttggtcgtttgagcctcaccagtttatttgtaagtggggaaactcagattcagagatactgtaatttaataaaggtaggttaattaaagatggggcagggatttattattcattcttttagcaaatatgtatggaatacctcctatatgtcagcctctggtactgatggtgagtagaacaatgtgtttcctaatctaacgggcctcacagtttaggttgccatccttaccattttcttagttccattcggatactgatgagaaaaaataatatctgatcttctgctggaagtatttttgataagaatataggttttggaataccatcggtgtgtgtaatctgtgaaatactatttcttagcttgcttttttttttttttttgagacggagtctcgctctgtcgctcaggctgaagtgcagtgccgcgatcttggctcactgcaatctctgcctccttggttcaagcgattctcctgtctcagcctcctgagtagctgagactacaggtgcctgccaccatgcctgacttatttttgtatttttgtatttttttggtttttgagacggtatctcaccctgtcgcccaggctggagtgcagtggcatgatctcagctcactgcaacctctccctcctgggttcaagcaattctcctgtttcagcctcctgagtagctgggaccacaggctcacaccaccatgcccggataatttttatatttttagtagagacgggctttcaccatattggtcaggatgatcttgaactcctgacctcaagttatccacctgccttgacctcccaaagtgctgggattacaggtgtgagccactgtgcccggcctaatttttgtatttttagtagagatggggtttcaccatattggtcaggctggtctcgaactcctgacctcaggtgatccacccacctctgcctcccaaagtgttgggattacaggcgtgagccaccgcgcctggcctttttagctttttttgaggaggcttgttatataaaaattcttcgttacttttttttgttttggtgggctggtaaatattgttggaacaaaccactaatgttttgcatcttgtatttctgtagaagcgatcctttcttcctttaaaatcaggtgttataaagtcttggggaagtagaacaaattttggagtggcaatcaggagaattaagttatggttctaaatttgctgtgtaaccttgagtgatctctgtacactttatttggagattagaattcatgttaacacattaagggttctgaaaagtcctgaggtaaagagaccggttttaactttgtttaacctattattttccaaacttgtcaagtattacattgatatttgatgacagtttcatatagttaatttgatactgtcattcctgtttacttacctggcttcaggtttgctcatttggctaaacaataatttgtctggttattaaattttaaggttttagcttgttattatcagaagggctaatagtgatttcctgtggttcaatttttttttttttttttgagacggagtcttgctctgtcgcccaggctggagtgcagcggcgtgatctcagctcactacaagctccgcctcccgggttcacgccattctcctgcctcagcctataggcgcccgccaccacgcccgattaattttttgtatttttagtagagatggggtttcaccgtgttagccaggatggtctcgatctcctgatctcgtgatccgcccgcctcggcctcccaaactgttgggattacaggcgtgagccaccgcgcccggccatgattcaatttttaagagatttttttctttgctttaattggaagtttttccatttgctgtactgaactactgtgtccttatatatgctttggctgtcagaaaggactgttttaaatatcaaaggagattctgggaagggatatattaatggaaaatattttatgagaacgtatattttttgtttaaatattttgcgcatactggaaaaataatgtttagtgctatttaggccatgggtaactactctgagaaagatcattttcatcgtagaaattctattgaaagtttacatttagagaagattatatggaaggtactatagcagaaagacatggcttgttgttaaacaggccaagttaaactcttctgccgctttgtgttcctttggacaagttatttcctttcctgttaggtggggatataacttgcaagacttctgtgagaactgacgaaatgtttgtaaaggggtagtagaacgcacagtcaatagtagacattgaataaatggttgctattattaagatggccgaattaaaagaaacattatactctggaaagactggtaaaacattttaagtgtcgctatgtcctgggcactgtttttggcagttgatagttttaggccagtggttttggaattttttttgattcttctgcaactggaataaaagctccataaaatacttttacttatggaaatttctgttttgtttgatataaaacggaatgacactaaattttttttcttttttttttttttgagacggagtcttgctcagtcgcccaggctggagtgcagtggcgtaatctcggctcactgcaagctccgccccccgggttcacgccattctcctgcctcagcctcccgagtagctgggactgcaggccccgccaacacgcccggctaattttttttgtattttagtggagacggggtttcaccatgttagccaggttggtctccatctcctgacctggtgatccagccgcctcggcctcccaaagtgctgggattacaggcgtgaaccaccgcgcctggcctaaatttatttctaaaggattgcagccataactattttaggtgatgattattataaataagctacagaacagacagttcaaatgattgtgatacttattaaagagttaagtatgggcaaaataattttatcaagacatctaattgagaaattgcattatttgtttacaacaattattcagttggtggatttctttctgcaggatggctgaatgctatactgagtttctgcattgcatgttttcacttcggataagggtgtttatcttctataaagtaagcctcacttcagtgaataaaacactgttttatatgagtaactttgaaatttagtcaaatatacagactaggcaatctaagaacaggctgtttgctcttaaaattatttattttaaaatacaatttgtcagtacataaatgcaaggaaacaaggttatttggtattattaacatatgcttttgtttctcaagctgttcgtgtttgcggcagtgagtattctcactaaaggttcaagctgttcgggtgtgaggctagaaacttttaaaatgtgcttggactcttcggtgaaaattattgatactttgatgctgtgatccttttagcggtatcataacttgtagtttctgtaatatcttgcttggaaggaccttgtataagtgcttaaatattttggaactaatttcaggaggagattggggatgcaaaatgaaattatatttttaggcagaaaactacattaagttatgtaagttattaacaccaggcctaaagttattgatgagactctcaataaaaataacatgaccagcagtagtctttttttttttttttttttgagatggagtctcgctctgtcacccaggctggagtgccgtgccatgatcttggctcactgtgacatctgcctcctgggttcaagtgattctcctgtctcagcctcccaagtagctgggattagtaggcgcccactatcatgcctacctaatttttgtgtttttagtagagatggggtttcaccatgttggccaggctggtctcgaactcctgacctcaggtggtccacccgctttggccttccaaagtgctgggcttacaggcgtgagcctgctgcacacagctgtcattttttttttcccaagaaaatagtcacccaaatattggaaacctacctttatcaaattatgtatgtttaaccaggaggctattttctctaatggtcttagtcattgttttatcactacaagacccaaactacaagtaaaggactgcaagggataggagtcttcctcactaatgattagctttattggtacgtataatttaagtactgtatatccatatatccagtttaaagatactatgttttgcaagtctgagaaaggtgacgagtgaacttcattaccatgaattcttagctacacattatattgtctttatttgtaaccttctagatttatgctaatgcagaaatagctctttgatgaaaagtttttgaagagtagacctttttcccctttatatgcaccatgtaccagaggtttgcacatattgagcactgtaaattttacatttaaagtaatataaaaagatgtgaatttttatgacatttatttggaatgccattttgtgttttgactcaatcgttcattagctatagttaaattataaatttgtaacgattacaaagatttcttagtctgggtcatggtggctcacacctgtaatcccatctctttaggaggccaaggcgagaggatcacttgaggtcaggagttcaagaccagcctgggaaacatctataaaaaattaaaaaattatctggtcacgatggcacatgcctgtagtttcagctgcttagaaggctgaggcaggaggatcacttgagcccaggaactcaaggctacagtgagccatgatcatgccactgcactccatatcacagacaaaaccctgtctttcaaaataaataaataaagatttcttagcatagattagatatgttaaatagactactaaaaaatcagcatattcatatctgagattgaattcaaggtgtggactatgtaacgtgttttctggttttaggatataactattgcactgatataattagttttttttttttttttgagacagggtctcactgtgtttcctaggctggagtgtggtgtgatgctatcatggctcactgcagcctggacctcctggtctcaggcgatcctcctgcctcagcttccagagtagctgggactataggcacgtgctaccacgcccggctcatttttaatttttttttttttttttttttttttttttttgtagagacagggtcttactatgttgctcagactggtctcgaattcctgggctcaagtgatcctcctgccttggtttcccaaagtgcttgcgattacaggcatgagccaccatgcctggcctcaagtacttttttctttctttcttttttttttttcattaagccctttctatcaagtacttttttttttttttttccttgagagggagtcttgctctgtcgcccaggctggagtgcagtggcgtgatctcggctcactgcaagctccgcctcccagattcatgccattctcccgcctcagcttcccaagtagctgggactacaggcgcccaccaccacgcccagctaattttttttgtatttttttagtagagacggggttttaccgtgttagccaggatggtctgatctcctgacctcgtgatccacccgcctcggcctcccaaagtgctgggattacaggcgtgagccaccgcacccggcctgtcaagtacttttttaaaccaagttttttggagctataattcacatacagtaaaaatctccattttacaatgtctagttcggtggcttttagtatactcacagggttgtaaaacatcaccactatctcattccagaacgcttatcatcccctgctccctcaaaacccatacatttcccatttctcccttccctcagcctctggtaaccatgaatttactttctgtctctatggatttgcttactctgaatatttcatataaatggaataaaatatgtggccttttgtgtctagcttctatcacttagcattttcagggttcattcatgttgcatgtgtcagtacttcattccttttaatggctgagtaatccattgtatggatatattaaatactttcaaatgagtgtgggtttgattattggagtctttaccttgagaaattatttctgaatctcagcttttgatacgttaaaaaaatctgttttttttgaaacagagtcttgcttcatcacccaaggaggagtgcagtggcacaatctctgctcactgcaacctctgcctcctgggttcaagtgattctcatgcctcagcctcctgagtagctgggactacaggcgtgtgccaccatgctggctaatttttgtatttttagtagagagggggtttggctatgttggtcaggctggtcttgacctcctgacctcaagtgatctgcctgccttggctcccaaagtgctgggattacaggcatgagccaccactctggcctatgtttgtttgtttgttttgagctggtgtctctgtcacccaggctggagtgcagtggcgcgatcattgctcactgcagcctggaccttcccaggctccggtgatccttccaactaagtttttgtattttttatagagatggggtttcaccatgttgctcaggctggccttgaactcctgggctcggtgatacacccgcctctgcctcccagagtgctgggattacaggcatgagccaccgcgcctggcctaaaaaatattttaagttcctgtttttctgctggagaagcactaaatagtttaccagtatctcgtgtttctgaatagccctgtcaatcgtcctgttgcagttaaatctttttactaaattcatatctagagtaagaaaatagaagaggtattagaaattacctgggccaactccttcgttttataaatcagaaagatgaatgactaaagccagattgtttgtactctggacagtaattttacgtgcaggactttctgtatgtaccttattttacctgggccttcttgtggttttgaaagagatgctgatgactttgatagagggaaatacatattaatgtaaaatttggcatttgcaaataggtagtttgtcatagtacttatactgtaaataaaaacaaagctgaggccaaggtgcagtggctcacacctgtaatcccagcactttggaaggccgtggcagaggatcgcttgagcttaggagtttgagaccagcctggacaacacagtgaaacctcatctctacaaaaaaaatccaaaaaaattagccaggcatggtggtgcctataatcccagctgcttgagaggctgaggagggagaatcgcttgaacctgggaggtggaggttgcagtgagatgagatcgcaccactgcactccagcctggatggcagagtgagactctgtctcaaaaaaaaaaaaaaaaaaaaaagtgaccaaacccaaaagcaaaaacaaagctagacttaggtaaggagagactttatttgaaaggatttttgcagtagaaggacatgcttactacaggatctgcaacacacttcaaaatcaaaccgaaaaaggctttttttttttttatagaaaggagaagtaagcagggctatcaggaactttgtgggaatgtgggccaaataggtaggggtgagcagattgcatgaccaggactatttaactggaaagcatttttttttttttctgcagtcagctaatggtcagaatgagggaagaagttgtgcatctactttcttaagcttagggcaagccaaagtttaggaatttgtggggagaagagaatcctgactaaagtttattcaagccaagtcaatgagtaagtaatgggcaattgtgatgtgcactggtcagtctccctgttgtttaaaacaaaatcagtcactgttgacaatggaataagagtcattgagaagttgatctcattagattgggcctgattatttacataggtgtagcaataatagtaatttatcatataataggtcttttaatattgccttgctgaaagtttttttaaggaatctgattggactttaaaatgcctcttgagactataaaggtaagtcaagaactgaccatcaggtttcacttgtaatacctataaatttgggtgaattcctgtcttgaagttcccaaaatattctaggatttttgagcctgccgggaagtgatcttgcttaattcacctgcaaggctgggaactctgtaagccagttaccaggccagttttcctaagaggactgtaagcgttggttcataaagtcaactgtaacttagaagtatttggtcatacctgattaaatgaatattttcaaatgtggcattccagtcaaagccttggttgcataagtaatgtttccagctagaaggcagactcattgaacctctgcagataactatattgccatgaaaataaaaataataagagtttttgaattctggaggagtaagacgggggagaaaaagataagtgtttatttcggtttacaaaaacatagtctccttaaattgttgtgagttatagatagcttcagagaaaagagaaaggggttccttatatccagaaaataggacgctaaggcatcagcaatattttaaacgaaacccataatcatccttcatcagtttattcagtcctatgtaattaattcttgttctgctggatctgtgttagcagtctcacgaacccatctgtttttctactagctgtttggaaatcttgactcagtccactggtgtggtctcagagttatttaagtgatgccatcagacgcttgtgttcaggttacctggcgtagtagttttcctttttctttctttctttttttttttttttttttttttgagacagagtctcactctgtcacccaggctggagtgcaatggcacaatcttggctcactgcagccttgacctcctgggctcaagtgatcctcccatctcagcctccctagtagctgcgaccacaggtgtgtgcgaccatacccagctaattttgtattttttggtagagaaggggtttcgccaagttgcccaggctggtctcgaactcttgggctccagtgatatgcccacctcagcttcccaaagtgtggggattagaggcgtgagccaccacacctggcccatagcccttttttattgaagacaagtgcactctggcctgtagctgatttgcaagtgctttcagggaagcattagagtaaaacagaaaactatctgtagatgacaaaatacttaaaacggtgatgattaacctattactgataatcttaaaagtgaaagatctcctattgcaaggacgaaaaaccaaacaccgcatgtctcactcataggtggaaattaaacagtgagaacacttggacacaggaaggggaacatcacacaccaggtcctgttgtggggtggggggaggggggaggggtagcattaggagatacacctaatgtaaatgaccagttaatgggtgcagcacaccaacatggcacatgtatacatatgtaacaaacctgcacgttgtgcacatgtaccctagaacttaaagtataataataaaaaaaaagaaaaaaagtgaaagatcttatgaaactttgttagaaaagataatgaaattggcaaggaagtttgatttttgtggcatgcgaactaaaatcaacccaaaaaagtgttagacaaaagcatatctataagcgtaatgattaactttattttattattattttttgagacagagtctcgctgtgttgcccaggctggagttcagtggcgcgatcttggcccaccacaacctctgccttctgggttccagtgattctcctgcctcagcctcctgggtagctgggattacaggcacgcgccaccacgccctgctaatttttatatttttggtagagacagggtttcgccatgttggccaggctggtctcaaactcctcacctcaggtgatcaacctgcatcagccccccaaagtgctgggattaaggtgtgagcaactgcgcccagccgattaaccttattttaaagaagagtggctagtacatgtcatttatgaatatagatgaatatattcattgcagagagaaaatctaaagacatataatcctaagatgtaatggaccatgaatatgtcaagagtatatcaagaatgtatatatgtatagagtatatcaagaatgtatcaagattatcaaggaaaaagatttagcagtctggagtaggtcgttaacttctatataatagcattccataagtaaatgatgtgaattcttaactgagaaccattagccaacctagaagattaaagaagccaaattatgaccaagttaacattgaggaaaaaaaatccctgaaattatgactgatgacattatactgttgtctaataccaggcaaagcagcaccagaactctgattaatagacatggacaatgagggcattgatgaatttctaggagctttataccttcatagaacttccaaaatatccctattaataacattttacctatacaaatttaacttaaacttagggagggtaagcctctctggctttgacagtgctttccatatgacccataacgtttgatcaaataaactattatttttaacatctctcttttacaaggtaaagggaattttgattttctagggccccttaggggaaatctcaaagacagttgttggtacaaaaggcatcatttaggaggtttgaacatttgattaaataggatcatgggccactgtggaaaaaaatacttggctacatatttaaccaaaagtgaccggaaaaaaaaaaagattttagttcagtgcggtggcccatgcctgtaatctcagtgctttgggaggccaagatgggaggatcacttgaggtcaggagtttgagaccagcctgggcaacgtggtgggatcctgtctctacagaaattagctgggcgaaagatttcatgcctatagttctagctcctcaggaggctgaggcaggaggatcgtttgagcccaggagtttgaagctgcagtgagctatgattgtgccgttgcaatgagccatgattgtgccactatactccagcctggacaacagggtgagaccctgtctcttaaaaaaaatattgaaaaaagtaagcatgggaggtaatgcagtggtgaagaaccttacccttttaagggtgtgaatacagttttaagtaattaaggacatgataaagtcagcattaagcacaggaaattctggtaagacacaatctttgccttctgtggagattattcagaaggcaaaggaaaacctttaataacttctttattaaaagcagactaatgggcggggcaccgtggctcatgcctgtaattccaacactttgggaggtcgaggtgggtggatcacaaggtcaggagatcgagaccatcctggctaacatggtgaaaccctgtctctactaaaaaaaatgcaaaaaaaattagccgtgcgtggtggcgggcacctgtagtcccagctactcgggaggctgaggcaggagaatggcatgaacccgggaggtggtgcttgcagtgagctgagatcccaccactgctctccagcctgggtgacagagtgagactccatctcaaaaaacaaaaatcaaaaagacaaactaataactgaagaaaatccgtcattttaacagagaaaactaaaatctagttttacgtaactataatatttgataagcacttaaaaacatcttacaaataaacccgtcaaatcttagccggctttggctgggcacggtggctcacgcctgtaatcccagcacttcggaggccgaggtgggcgaatcacttgaggtcagcagtttaagaccagcctggctaacatggcaaaaccacgtctctactaaaaatacaaaaaaattagctgggtgtggtggcgagcgcctgtaatcccacctacgcgggaggctgaggcaggagaatcacttgaacctgggaggtgaaggttacattaagcccagattgtaccactgcactccagcctgggtgacagagcgaaaccccatctcgaaaaacgaagaagaagaaaaaaatcaagccaggtgcgttggctcacgtctgttaccccagcacattgggaggctgaggtgggtggatcatttgaagttaggagttcgagaccagcctggccaacatggtgaaacctgcctctactaaaaatacaaaaattagccgggtgtgttgttgggcgcctgtagtcccagctacttgggaagctgaggcaggagaatctcttgaaccagggagtcggaggttgcagtgagccgagattgtgccactgcactccagcctgggtgacacagtgagactttgtctcaaaacaaaacccccaaaatattagtaaatatgtatatgatatttctgtgtgcagtgaactgtagtaggcattgatgataaaattagttataaggtatggttcttgtttccaagggctgagatcctagaggtaggaagtatgcttaaaaaaaaaaaaagctaatatcatgtaagtactaaagactaaggattaaaagaagtaaagctgagtcaattagaaagggttacagagtaggtaaggtttgactctggccttgaaggacttgcttgctgggagaaaaagagaagtatggagtaggcaggaaaatgaatactctgcaatgatgggtgtgatgtactcccagtttacatgttttgaaacctgtttgtatgatgcagagactataaaagattaatttagagtcctaggtagaagtcatggtggaaggctgaggtattgaggcattttgtaaatttaggcaaggggaatcagaatggcttttgagttggctaaactgaaagtattagaagtagaaaaggaaaggggagaatattgagataacttactattaggatattttaggcctaaagtcatgaaggtctagagtaggatagtggttttaaaaatggagaagaggagacagatttaaagacatgcttgtaaaataagagtcaacaagacagtaattgtcagactaggggaaaaggggaggggctcaaagatggctccaaggcatgccagtaaggttagaattgtgtaccattgactggtgagggattttgttgttttgggggaaaggtgatgaatttaatttaacgggaggtagagatggccaacaaaaagttagagggacagaactagagatgatgttttgggaattagctgcatagaattgcttgttgaccaggtgaactttaattaatttatttccttccttccttccttccttccttccttccttccttccttccttccttctgttatagcacaacttatatatttcaaatggacaaaaaattagttttacagcatcttaagataaatttcctttgaatgggagcttcctttccagtactttgaggtctacaagacatatctagaaaatttgctgctgtggaaaatgaagactgcttaaattgaatgagggggaagaggaagggcctgtggtttttcttttcgattaattgctgtaacactgtgttgtggtttttcttttcgattagttgctgtaacactgtccttgaggtggctgagggagtttcatattttctttagacaccattaggcgccaaagctcttgcaggacaactttggtgctgtgaattctgccattttgctagcactgatatggctcttgggtccaccaatccattagaactattaactccattcatattaattttttgttacaaatcttacaaaggggggtgcttctgggtatttaggtccacattttattttaaggctgtatattcagttttcataaattgttcttgcaggcccaattatcatccctgtacgtcttgtaagtgtcacgtctttatcattgtctagacctcagctaactgccatctcctactcctttctggccttctttgagttcttccaaaagtgggaaattgcaagggacttttacccccgagcctgtggtggctgccaccttgtgttgctgttgcttgtgaactttaattttttatactctgtcatttggaacaacagagagtcttaggatacctatatataggaagtggaaggtttgaaacaagacaagaaaaaataggtagtattgtatgaggagaacattctatataggtagggatatagtcaacagcattgactgctctagaggtgttaagaataaagactgagaggctgggcgcagtggctcaagcctgtaatcccagcactttgggaggccgaggcgggcggatcacgaggtcaggagatcgagaccatcctggctaacacggtgaaaccccatctctactaaaaatacaaaaattagctgggcgtagtggcgggcgcctgtagtcccagctactcgggaggctgaggcaggagaatggcgtgaacccgggaggcggaccttgcagtgagccgagattgcaccactgcactccagcctgggcgacagagccagactccatctcaaaaaaaaaaaaaaaaaaaaaaaaaaagagtaaagactgagaaaagaccactggatttggttataaagatttagaggaagcacttgcagttgagtgatggataggaagttagataaaagagtaatagctaatgaatggtagtgtgaagtatatataccaatgttataagattttgcagttagtagaaatataattattattctgatggtagcaaggttagggttattaaaacaaaacaatagcaaggaacctggcgtaaaccattgaaaatacgagaaatacagaacaattgatagagcgaagttgtagagaggaggtaaggaggctgaaccgaaagtattgctttagccttaggaggaaggccatcttctcatttgagactgaggacaaggtaagggaagatgggtggagagaaaattttgagaggtataaattaagatgttggggatgtatgacatttaccttgtatcctgcttcactgagattgttttatgagatgatctgaggataaaggattcagggcatggaaattagtctttaaaagtagaaaaggcttagaaaggctggtagagaaagtttcccaggagtttaataaaggaaaacaaggattcctgagcactgtgagtgttccactgaagagaagtgatggtgattatttgggttatctgaatactaggcagtcagaaagtaagctctctggaatggaagatactggcatgttccagggagcaagtatgtggttccagtgtatctgtttggtagataaaaacaatgttacaaatcaaattatacctatcagatatcccatttaatatgttgctgaacagatactggtgacaatgtaatagaaagtattcaagcatcagaagggtggttggacaggatgaaccctgggatttcctttcaatagtgtggtttatgtgcagcagatttatgtacagtcctttacaaatcctcaattgtaaccagtattgctaacttaaaaaagattaactttgcctccttcacccgttttcaggagggagaagagactcagaatgcttgtgaggccttaactgaccagaaagcgtttttggattttgtagaccaaaaatattcagtacacgtagaagtgttaaagtttgacttgaaagcaatgaaagacatttggctgccacctaatgtcctatagctttgatatagttttccaagatagtgccataaagaaggtgcccagtaaatattagatgattatcactcttgaattttcaattttaagtgtttcgtgggtattccttagccttatgcagcacttagcattgtatccttcactagtagggaccttttttctgatgtttatatttggcccatagtatgagagactcagtatagtgggctctgtggggactgataaatcagtgtgatgtgtgaaggccagaaatgaattaaaagtgactctgttagggaagtttatgaatttgctgatagctgcagcagatacacagaataagcagaaagattggttagccactttttaaaaaagctgtctgccagtttgtttttgactaagaaagttggatttaagcttagttagggaagtttatgttgtacttatagatgaaaatagtatacatttataactatttgacagacacaatctatagtgtaaacatcacttttttcttacacttttttgagattggagtaatttcttgaaaaggggaatcgttacttctaaatggtagttgggcttggcttcagatgacacagttgtagacccttagtaagtaattatgaaagaagatcatgtagataattgtatcataactcactcttttttttttttttgagacagggtctccctctgtcacccaggctcactgcagccttaaattcctgggctcaagtgaccctcccattttagtctcctgagtacctaggactacaggcgtgcaccactatgcctggctacttttttaaattaatttttttgtagagatggggtttccatgtgttgccaaggctggtcttgaactcccgggcttaaccaaagtgctgggattacaggcgtgagccaccgtgcctggcttggtcttacttttgctgcctcatttatgttctgcattccagcctctagatgtgtgctatccaatactaccactagccacacttgtctatataaattggaatgaattaagattatataaaattggggccgggcgcagtggctcacgcctgtaatcccaagcactttgggaggccctggcgggtggatcaccggaggccaggagttcaagaccagcctggtcaacatggcgaaaccccacctctagtaaaaatacaaaaaattagccggacccatagtggtgggcacctgtaatcccaactactcaggaggctgaggcaggagaattgcttgaacctgggaggcggaggctgcagtgagctgagatcgtgccattgcactccagcctgggcaacaagagcaaaactctgtctcaaaaaaaaaaaaaaaaaaaaaaaaagtttatataaaattaaaaatttaattttgtagtcacactagccacattttaagcgctccatagctgcgtgtgactggtggtactgtgttatgcagtggagaggacatttccatcatcacagaaagttctgtaggacagtagtgctctagatttttaattgttgcttgatactaggaaagtaaatgtcagaagcttggaatagatatttaataaaaaccaaaaaacatggaatttatactacctcactcccaacagcttcaactttctcaaagttaaatgttatttctgtaagattggctttatatttagtttcgggtcttttcaaaggtcattttaatagtaatatagaacagaataaagtagctttactaagaactatttctgtcaaactgtaacagttttattaaggtataattgatagacaataaattttgcttatgttaagtgtaaaatttaataagttttgacatgtttacacctccgaaaccatcattattgataatatagctcatcacctgcaaaagtttgctcatgcccatttttaatcctccccctcattcttttgcaccttctttccctattttgagacagccattgatctgctttgtgtttttacaaaagtttgccttttgtaaaagtttatatagatgagagtcatgcaatatatacctttgttttggcctggcttctttcattctgaattattttgagatccacccatttttcatgtacaaagggttcattattttctgttgtatggcagtatcacagttttttatccattagtctgttgatgacatttgggttgattccagtttgggttattacaaataaattggtatgagcatttgcatacaagtctttgtattgacatatgtttttgtttctcttgagtaaatacctagatgtggaataaacagtatctagctattgccttggattgtatagtaggttgtatgtttaaccttttaggaaactgccaaactgttttcccaagtggctgtaccattttacattcaccccagtagagtatgagtgttccagtagctccatattattgccaattcttggtatagccaggctttaaaattttatctgagttattttaacaagaaaagactatcgtggtggaaatagttccccccatttcctatgtcttattttttaaatgctgcaaaaataatattttgtgtgtgaagtttagatggtctcctaatgatttatttattcttttcttattttcgacagtctttgctcactaataccgatttgaaacgcagtttataagaaccaatacgttttcttccttttcacttacatatttttctttttttgttctagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggtaagtttttgtacagtgtacgaagatcatcatacctcctttcggtttttctccactgacatacaccaccctgacccctatgagaaaagaaagatcgaaaacaggaattttagattctttgggcttctttgttgagtagacttgaatgtggaaagttacgttgtgttattattatttttgacagggtttttgctttgtcactcaggctgtagtgcagtggtgcaatcaaagctcactgcactgtcagcctcccaggctgaagtgatcctcccatttcagcctcccaagtagctgggactttaggtgtgcgctaccacacctggctagctaaaaaaaattttttgttagctgggcgtagtggcgcacatctgtaatcctagctagacgggtggctgaggcacgaaaatcacttgaacccaggaggcagaggttgcagtgagctgagatcgcaccactgcactccagcctgagcaacagagtgagactttgtctcaaaaaaatttttttttgtagagacagaatttcaccgtgttgcccaggctggtcttgaacccctgggcttaagtgatcaatcgctctgccttggcctccccaagtgctgggattacaggtgtgagccactgtgcccagtgtgttgtgttcttagtgtttctgtaaatcgttttgggtttctaatagccatgtttatatttcttgggttttcttctgtatttattttttgtgatatcagaagataatttaaagagagagaagaaggaatgaaatgagaagtatttgatagcccaagatgagatagactaatctagatcttataccttttattatatacacaatgatactgtgatactagtgtttttttgttacactctgaagcgttatttaatgtcagtattgaatgaaaaataaaaattattaaataactcatttctagttagctaaacatatatttgcaataaaggtttattttctaatgagaaggaaaacttaaagctctgagtaaatctcatttcagagtgtgaactgtatcctcacattgcttctctgttactatgtctcatttctactgttagtatacaccattttgtgatatttctttattgaataaattgtcatggctagtctgtcatggctaagtatagataactatctgaacatgaacctaaaatgactaatatttggttaaaatccaaagataaataacctgtactattttaatactttgttttctttagctttcagttgtattagaatgctttaaaactcatttcacttatagaaaggagtgaattctttttatgtaataaatgagaacttggggagaatggaagaaaggtttatatgtgcttctttatcttgatatcaggcctggttacagaggttgaacaggatgccatgttgtagaaaaatgagaagactgatttgactgtaaaggattatgtgggcagtagtatagggaaattttagagggagatgtctggaaatacaaatatgtattttttagagtgaaattaaaacgtgtttgttgaagcaagatggtgctcttaaagcaccaggaaatattgtagtggctctgatcgtaggaaaaacgattggatgtcctgaggaggaggtctcagatgtaactgtagttatcaaagaatttggttgttgagaactttatagatatttttgagaaacggagtttgtgttttgctaacagagtttgtaaggctcagagggtgttgaaatgtttctgaggttactgctttgtagaacacataggattttggtgcttgtagtcgtcattagggaagaataccgtggtgaaaagataaagttcttttttcccctcttcttgacaagttcaattttaccactgtaagggtgatgattgaaatttaatgaaatatctgttaaatggttattatgttcagagttctgcattttgtactctggttggagagagggggtttggtttatctttactgtttaaggacagaaaacttgggagagacaactttttcttcttcaaagcatgtttatttgcattatgtaacatgaatgtgaagagaggaagagtgttaaaataattagaaggggcacaagagctgttatgagcttcattaccaaattttggaatgggatcttgatcatttctataagagattaatgattacctgatagtacattattaaagggaactgaatgtatatagttcctcttgactcttcaggatctaacagttcagtgagtaaattaatcattttcattttgttccccaaaactaatgagctttacttctgggtagcaggtctgataagtatcttctgaagtaatttcgccatttgattaaaaaatactttagagtttctgtggctttaatttatccttgttatttctcattattgaatgtgagaattcaccaaagacttagctgataaaaaagattattggaagaatcagtagcaatttactttgaaggtagaaggtagtgttatttagcttctgaaggtggttcagtgaagaataactctttctgtggactaaaggcttggtcaaacacccagtgaaatattttgtattatttttgatgtgtgtggttaatgtgggaggcagaggaggggagagtaggggagagagagtgggtaaattcaacccccctccccagctttaacagtcctctcaaaatttcttttaattttgagaagtcattttgtgtcatggttattttaaaaacgactcaactggaaacaaatagaatctggtcaaatggtatatatacatttgatatatgtacaaatgatggagcgtatttaaaattatattttaaactcctacactgaaaaatatattcatcagatgatctttcagtgttaatgatcttagatttgtatcgtggattgtggttttagttgaaaagtaattataggtagagtacatcatttgtcaaacagaagagatgatttccagatttattttttgggggaaatacgaagtttgagttccagacaaagtacatgaaaacagtgctgaggaaaaatgtagacttttcagagttccaggatcctggattatgaggttcacaagagctgattgagctctctcatagcaacttacgtaaagggaaagctattgaatgactggtattgtttgagccctgggaactagtgcagacatctgtgtgctttcggatgtatggagttctttgtgtaatcagtccatttagcctagactgaaggaagatttttattcctctctctaaatttggcctctattatattagtctgagatttttttttccttataataatgactagcagtatacagttcagactaagcaacgggaagatgtgtgtatgaaattgttagagaaatgaacaaccagagttacagtaaacagttgtcttatgttacagtgagtagaggtgattcctatgtggctgctcctaatgctggagcccctcagtctgattccacagttaccatgctaagcaaccgtactaatcttggtgatgttgaggacctgtgtcaagtttaagggtgttttgtttgtttgtttaggatcctttcatattccaaatcattttagattttttttataaagttaaactttaatgattcaatttgaagtgaatttatattaaacagctttgaatgatatttatattttaaaagtatgtatttttatttattatttatttatttatttttgagatggagtctcactctgttgcccaggctggagtgcagtggcgcgatcttggctcactgcaagctccgcctcctgggttcacaccattttcctgcctcagcctcccgagtagctgggactacgggcacctgccactttgcctagctaattttttgtatttttagtagagacgggttttgccatgttagccaggatggtctcgatctcctgacctcatgatctgcccgcctcggcctcccaaagtgctggcattacaggcgtgagccactgtgcccggccataaaaagattctttttgtatggaaagtggaaaatgtagccagttacatttaggcagattatatagattcacatatgtttggagatgaggttttttgagatcattatctaaaaaataagagtgatgtgttagaagaaccactgatcttttcgggaaatctggattatgggtttagcttgaatggcatatgaatcagggtcttggaaattaagaaacaacaaactcgtggtgtgtgtctctttgtgtgtgtgtgtgtacatgtgttctcaaatgttaatgtagggtttttttttttttaatatcttaactctcatccagttttagtttcttcatatcaagtaatatccatcaccgtgtctcaaattaataagtttcaattgtattgtctacttttttatgctccatatctcctagcatttattgaaggaattttgaaggggagtagttgtagtataactgaatgcctttacataacacagtattttaatagctttgctttttaataaaagctttctttgcttgtaacattgagcttttcattcatccttagtagaagattgaaacttggtgattataaagaaaaggataccttcctctgtatggctggagatgaaaaaaaaaaaagaaaaagaatagggtacctttatgagtataggctgcctgcacttggggattttgtctaccttcgatgtattccagagttgatgactcttcagaaattacaatgaatctttaagattttggaaggaggggtttgtcagctaatttgtgaactaggaataaaatatgactgtttttatttttgtaacaattgatattgatactatatttcttttagaaattttcacttaagcttattgagttttatactgtttccattgtcctaccacttggaccgtgcctttccttcctccatcagctctttaaaaatggaacagtttaaaagtgcattattttctttgttctttttctgagatcatatccgtttccagttggcttttgcatagaagcagatagccaattatttaaaatctaaagctttagactggatcttgctttaaagcactgtccctgtgtatgaaggatcttggtgtaaacaacttacagttttgaaggatgttctgttaaattgggaaggtctgttttctatcccttgaatcctagaactggaagggaatcttaaggatcctctagctaaatgccttccttcccttctttgggtgaagaaaccaaggcctttgaccaagataaatgagagggagctatattcttagttgaaatttttgaattccgtgtttggtgctttttttctttgtgaaaggtatcttactgaagccattgttttttgttttttgtgttttttttacgagttgaattactttaaaaaattgaacatggtagctttgtttaaaggaccttttaaaataagtttcatgtttttaggtttactcagtgtagcaatttcttattttaccattgctttttgcatcccagttaatccatttggattcagcttccttttgtttgaagtatgcccttcagtgtttctttcaataagcgtctgttaatagtaactcttggtctttgtctaaaaatgtatttattttgccctcattcttgaaatgataattagttgagtatagaattctacgtgattagttattttcactcagacctttgagggtgtatggctttaattgttggtacgattaagtctgtattgcattgtaatttatcatttatcttttttaatatttttgtggtttttaaaagcttctcttgatttttggtattttgcagctttgtctaccctgtgtctagatgtggatatatttttatttatcctggttaggattcatatttctagaatctaagcatttttgtcgtttgttaattctagagaattcttatccttttttttcttaattttccttcgttctccttagtctcctttggaactcttgtttgatatgtgttcctttctaattccctgttcctttcctcttaattttgctcttttatcttctctctcattatttctctgagccactttctgttttttttttttcttttgtacctgccatctagatacaaaattctttcttcagctgtgcctaactttgcagtttaacatgttaattgaggttttaatatcagtgactatattttaatttttttagaagttccttgtgcccccttatgaagaaatttcagctacataaaagtagagaaaacagtatatcagtaattttagacttggaaaaaaagttgcaaaaattgtacatagctctagtgtaactttcacccagcttccctaaatattgacattttgtataaccatagaacagttatctaaccaggaattaatgttgatagaatactgttaactaatctgtagaccatatttgaatttctccgttttccccattagtcctttctctggtccaggataccattttgcatttagttatctcctcggccttttctaatctgagatgttttggtagtctttctttgttgttcataacctggacatttttgaagattattggccagtcatttgtagaacgttcctcagtttggctctatttgctgtttctcatgatttgattaaagttatacatttttggcaagaataccacagaagtggtattatgcccttctcagggcatcctgtcagcaggcacattatgtggatactgggtgatgttacagttgatcacttggctatggttttgtctgctagtttttttttcactgtagttactgttttttcccttgcaatatatatttgaggctgtgcaattatcctgtttctcatcatacttttatccacaaattttagcattccttgatggtttttgcctgtgttaattattactgtgatgtttgctgtttgccaaatagcgatttttctagttccattattccttctgtgtgcattattagctttctaccttaacgtagagctgtcctgtctctctcatttatttattcagttatttatattagtgtgatattgtgaaaatatatttggtctcagtcccctggttcttggcacagagcttctaaaacccttgtaatttcctgagcagtagggttgctaggtgcatcttttgttctaatatttggtctttgattccagtgcctgacatggaactcctaatcccttggaatttcctgggtgataggaacatcttttgttctaatgaggcaactcttgataggcttctggatgggggctggtcaccagaaagaccaagccatgattagaagcttggaactttcagctccacttcacatccttgggcaggggagagggactggagatagagctaataatcagtcatacctatataaaaagcctcaaaaaaaaaaatccctgaattatgggggtttggagagcttctgggttggtgaacacatccattttcatgtttcattaggatggaatcacctgtgctcgtgacccttctggatctctccctatgtatcttttccatgtggttgttcatctgtatcctttgtaatatcctttataataaactgataaatataaataaagtgtttcccggagttctgtgagctactttagcaaatgattgaacctgaggaggggattgtgggaacatccagtttatagctggccagtcagaagcacgggtgcctgcagtgttggaggcagtcttttaggaccgagcccgttactgggatctgatgctgtcttcacatagatagtgtcagaattgaactggcttgtaggacacccagctggtgttgtagaattgcttggtgtggggaacccccccgtcaccccgcccagcgatctggtgtcagaaatgttctgttatgttgaccctgtgagagaaggaaatgtgtttttctgatacaattagtatggattcatgggcatttattttatcctgtaggttgtaatccaaaactgtcatgattttcttgctcaaattgttgcagatttgaccactgggagctctttcaagttggttcctgagtcatttgtacatgccctcattgtttgtttgtttatttatttatttatttattttgagacggagttttgctctgtcgcccaggctggagtgcagtggcgccatcttggctcactgcaagctccgcctcctgggttcacgccattctcctgcctcagcctcccgagtgactgggactacaggcacccgccaccacgcctggctaattctttgcatttttcagtagagacggggtttcacacctgttagcccggatggtctcgatctcctgacctggtgatccgcccgcctcggcctcccaaagtgctgggattacaggcgtgagccaccgcgtccagccgccctcattgttttttaagtacttatttactttctggcgactccaggcagtccagactcattgtgtcctttttctgttccactccttgaatcaactatttctccaaggagttctggctccttttattagagaatggtatttagaaatgaagatgtggaaactaggtatgctctttgctactggattttcttttttctttttctttttttttttgagccggagttttgtccttgttgcccaggctggagtgcaatggcgcgatctcggctcactgcaacctccacctcccgggttcaagtgattctcctgcttcagcctcccgagtagctgggattacaggcatgcgccactatgcctggctaattttgtttttttagtagagacggggtttctgcatgttggtcaggctggtctcgaactcccaacctcaggtgatccgcctgctttggcctcccaaagtgcgtgagattacaggcgtgagccactgctcccggctgtattttcttttattgtatttagtttagtacctctcagtggacagagttaggaaatatatgatgtatgtagacacacatacccctagttctgtgtctttgctatacgtaaaaacaaattcatgttatcgccaattccagtctactaccacaaaattatcattgtagtcttctcccttttcttacttgggatatttacttctattctgtgatagtgagaaacctggctctcattatcatgatagattttcttatttgcccatcttagtgtacacattaagggagttttaaaatcattagcctataccaccattgtgagaaacgaatttactttggtgttatgtgaaacaattgacatgttcctaacagtaaaaaataatacaaaaatttatactcaggaaaatgttcttcttccccatcccttctatcctagtcccatctcctacccccttttttccagtctttccccacccttctctataggtatcttagtcttaataatttctgcttttttcttgtgaatttgtttatgtacaaatgagttgatacgtgtgtatattctttttttttcttttattatatctccgttctcagaatgtgaatgtgtatattctttttttttttgagacgtagtctctctctgtcgcccagagtgcagtggcaccatcttggctcattgcaacctctgcatcctgggttcaagcgattctcctgcctcagcctcctgagtagctggattaacagatgtgcgccaccacacccggctaatttttgtatttttagtagaggcggggtttcaccatgttggtcaggctggtctcaaactcctgacctcgtgattcacccacctcagcctctcagagtgctggaattacaggcatgagccactgtgcccagccgtgaatgtgtatattcttataatcttcttttcttacatgaaagagtaacatacagtagatgctcttttgcatgttctttttaaacttaactttttttttttgagacggagtctcactctgtcgcccaggctggagtgtagtggcacgatctgggctcactgcaacctccgccttccgggtccaagtgattctttggcctcagcctctcaagtagctgggactacaggcatgtgccatcatgccttgctaatttttttttttttgagatggagtttcgctcttgttgcccacgctaaagtgtaatggtgcgatcttggctcacggcaacctccgcctcctgggttaaagcaattctccttcctcagcctcccgagtagctgggactacatgcattcaccaccacgtctggctaattttgtatttttagtagagacggagtttctccatgttggtcaggctggtctcaaactcctgaccttgtgatccgcctgcctcggcctcccaaagtgccggaattacaggcatgagccaccgtgcccggccaaaacttaacattttgaatgtcattccatatcatttcatagagatcttcctcattgttttttgccagtgcatagtataccattgtgtgagtgtaccatagtttattcaactactctctatgtgtaggcttttaggctggttttttttttaattagctgagatattttaaagcagattcacacatcgatatctcacttgtaaatactttattttccgtctctaaaaaatattttttctagaatcataatgccactgtctttcacacaacttgcgatgaacaattctttaatgttataaattagtctgttcatactcagatatctgtgtctcagaaatgttgctttatagttggttgtttgaaatcagagtccaaacatttggtttacaagttgcatgtggtttttctagagcagttcagttggtcctccccctttccctttttatctctcaccttgttgacttaattgaaaagactgggtcagctgtcctatagaatatcccagattttttattttcattcattcattcatttatttttttgagatggagtctgactctgttgcccaggctggagtgcagtggcatgatcttggctcactgcaacctccgcctcccgggttcacgccattctcctgtctcagcctcttgagtagctgggactataagcacccaccaccatgcccggctaatttttttgtatttttagtagaggcggggtttcagcgcattagccaggatggtctcgatctcctgaccttgtgatccacccaccttggcttcccaaagtgctgggattacaagcatgagccaccgcgcccagacaatttttttttctaacaaattattgtggtatttgacttatttttatccccctgtgttacttggaaagaaagatttgaagacttgattagagacagatttaacattttgacatgaatgcctcataggtagtactgagtactttgtatttgtcacatcagaagttgtcctatattgtagtgttgctaagattattcagtaggttcagatggtcagattttctgagcagttgggatgttaggtgcatcttttgttataatatttggtttttgactctagtgcctgaaagttactatctttatttgtaagttgagccctttcctcttgtgtccttaagttatttgtgggatgatccttttgtattttgccaaatacctagttccttattaaccactcatctattgattattttagcatgcactgaggattgcttcttgtattttcttattagagatatgttattgtttgatgatgtcttttcttgtgtcatatattttattccatcttttatgtgttttcatcatttaaatatttataatctctatcaagttgttcagttttctgaagttcttaaaaatctacttctgtttttttttttttttgcacctgctggattcttgcttaaggttaaatgtttcctcgagtgttttatatagttttggactgtgaacagatcttcagagaggctgtccttgagaattctgaatgacttgggggcatattcctccagagagattttgggttgcttttgccaagttcactggaagtgtttccagtgaccacttaaatttttttttttttttttgagacagcgtctcactctgtcgcccaggctggagtgcagtggtacgatctcggctcactgcaggctctgcctcctgggttctcgacactcttctgcctcagcctcccaataacctgggactacaggcacccgccaccatgcccggctaattttttgtattttttagtagagacagggtttcaccatgttagccaggatggtcttgatctcctgacctcgtgatctgcccaccttggtctcctaaagtgctgggattacagtcgtgagccaccgtgcccagccgaccacttaactatttaaagtataatttatatacagtaaattgcacagatctcaagtgtgaagtttgagttttgtttttgtttttgtttttgtttttttttttgaggcagggtctcgcttcgtcagtggcgcagtctcagctcactgcaacctttgcctcccaagctcaagcaatcctcccatcttagcctcctaagtagctaggactgtaggtgtgtgccaccacatccggctaattttcatatcttttgtagagatggggtttcaccatgttgctcaggatggacttgaattcctgggctcaagtgatctgcccatctcagcctcccaaagtgttgggcttacaggcatgagccactgcgctgctcagcatgagttttttttgttgttgtttaaacaaaaacaaaacaaaaaaaaaaccgtttcctgggctgatctaaaaacttctgggactacaggcatgagccactgtgcccggcttagtttgagttttggtaaatgagttatcaaatgttatcattgccttattcaagcagaagtcattttttatatttaatttttgaagttgggagtttctgtactatgtggatagaataaatcaaactctaaacctatgtaggggcagtcttatgattatgaaatctttggtgatctttcctaccttttcagagcctagggcaagacaaaaaaggcttcctgtgtccctctgccagtgggcagatctttctacttcattgttctttgagagtccatgctttgtgcaggaatcttacttctaacactgtgtcttgtgtgccaagatcttctctggcttgtcattggaacagaagtttctcagtttctgaaatcagaaaatccagggtcgtcatagcatcaggtcaaacatgtactgcttttttttttttttttttttttttttttgagatggagtcttgctctgtcatccaggctagagtgtagtgtcacgatctcggcttgctgcaacctccgccacccaggttcaagccattctcctgcctcagcctcccaagtagctgggattacaggcgcctgccatcacacccggctaatttttgtatttttagtagagacggggttttaccatattggccaggctggtcgcgaactcctgaccttgtgatctgcccaccttggcttcccaaagtgctgggattacaggcgtgagccactgcgcctggccatgtactgctttttactttcctgttcatttttggtctcaggagatttctcctactttcttgataagttctacatttaaaggggtgtttgtatattttattttgtgtatatgtacaaatcaaataaaaagattcaccagtagttctagatgttttgtaaaagaagtattttctggttgtctttttaccatattaccagaatagaaactctgacttacatgttttaaaatattgtctattctttcatgtaccatgtgcatgatagttgaggattattcatacttgctaatatgtatattaatgacttattttaattatggataggattatataagtaacttcaaggatcatgacatgatttatgatctagtatagatctgggtcacttagtttttatagctcaagtctcaatgtcttaattagtcacctgtgtatgtaattacatcttgtaaagggtgaaatttcatccctttagtctagatttattgaaactgaacattttcattatgggaagccgaattcagattgagtatacttaccaaattagggcttgtgaatattttggaagatttgttgttttatccttacctaatcaaataaattaaatgctttggattgtaataaaaatgtgtaaagtaaatttgtataaaatggcttgtgtgtctagtcttattatcagtttgagatatttttattttcctggcataagaaattgtgacatcttgaaaacttaatatatgtttacttgctttacttccctcccagttaaaatgaagctcatcttctacctttcactccatttaaaaattattttccagaaagcattacaaatgaatatgagaccagacacagcaataaaattacatttgtgtggacgctaatgaacagcatataacagcctggtcctggttttcatgatttttggatgaatagcagatgtgtatactattgcaaagtggagctgtgaccacatatatttatttaatcattatcaagtacatatgttcattctctcttaattcaaagccaaaataaagctaattgaggccaaaataaattagaggccaaatagattacataaccagagttagtaaagattactgctgaagtgagatttcttctatataagcctgtagcctagcttttgagaagccaagggagatatttatcacacactttctgtttcccaaagcatactaaaattggctttaaaatatgttgctgataaaagcccttgcagaatatattacacaactagttgaattaagcaacttcattgttaagtgcttttatgtgtctacaggtttctaaggtagattctaaggtagattaaatacaaaaacaaaacaaccaaacctgctccttaatatttgcacaccaattattatttattttttgaaagagtctaaaataaaatgaagtagtcaaggagtttatgtcacagtttaatttttaaatggctgagttaagggagagattttcaagtctcagtgtgagatattcttcttcttttttttttttttttttgaaatggagtttcacttcttttgcccaggctggagtgcaatggcatgatctcggctcacagcaacctccgccttgcgggttcaagcgattctcctgcctcagcctcccaagtagctgggattacaggcatgtgccaccatgccaggctaattttgtgtttttagtagagatggggattctccatgttggtcaggctggtctcgaactcccaacctcaggtgatccacctgccttggcctcccaaagtgctgggattacaggtgtgaaccgttgtgccgggccgatattcttcattttcctcataatagaaaatgtttgtgtcatatcctagcagatcttgagaatgtttttttccctcaggacttttcctgcatcacatccctgtaccatgtcctctgagcaggcctcagtagctaccactcctcttgggttagcttcagtgctgcatccttgaatgcaatgaatgcctctttcctagctcgctggggcctattgccattttctgctttccctagagcagtggtccctaaactttttggcaccagggactggttctgtggaagacagtttttccacaggcactgggcagtagcggggtgggtgggatggtttctggatgaaactgtgccacctcagatcaggcattagatgcacaaatggaggtgtgcaacctagatctgttgcatgcgctgttcacaataaggttcgcactcctgagactaatgctgccactgatgtgacaggaggcagagctcaggcagtaatgctcgcttgcctgctgctcacctgctgtgcggccagttcctagcaggccactgactgctactggtccacagcctggggcttgaggacccctgcactagagaagggcacagtctcataaagcagatcctgagactaaagactcattctgctgctgggtcactgcataaactgaagacatctacttgttaccttttaggcatagcatttatctcttcctgttaggttctctttcttttttttttgagatggagcctcgctgtgtcacctaggctgttgtgcagtggtgtgatctgggctcaccgcaacctccgcctcccgggttcaagcgattatcatgcctccagcctccccagtagctgggactacaggcgtgcatcagctaatttttgtatttttagtagaaacgggggtttcaccatgttggccaggctggtcctgagctcccgacctcaggtgatccccctgccttggcctcccaaatggctgggattacaggtgtgagccactgcacctggccaggctctctttcttaatccttaccttggatacataatttagctactctcggggaaatgtgccaaatgaggatttggtaccagtcttattgaccactgaccactaaaaatgagtgccaagctttacagaacagcaaactgaagcagaaagggctcccctcttgccttttgtttgttttttaaataaaagaccattttttagaacagttttggacttacaacagaattggctgaaacaaaatactcctaatttctcccttccatcccctgtattgttgccatcattcatttcacttatatataagctaaaatcattgactacactgtgctgttactattttgaacaaactgttacctgttagctcaattaagaataagaaaaggccaggtgtggtgacttaagtctgtaatctcagcactttgggaggccaaggcgggtggctcacctgaggtcaggagttcgagaccagcctggccaacatggtgaaaccccgtctctaccaaaaatacaaaaaattagcctggcatggtggtgcgtgcctgtaatcccagctactcgggagactgaggcaggaaaatcgcttgaacctgggaggtggaggttgcagtgaggcgagattgcgctgttgcaccccagcctgggcaacaagagtaaaactctgtgtcaaaaaaaaaaaaaaaggaaaagaaagtttttattttaccttcacttattccttctctaatgccgttactttctttttgtagatctatttttgacctatattatttttcttccttctgaagaactacttttaacatttcttaaaacgcaggtctactggtaacaaatccctcaatttttgttggtcttgagaaagtctttagttctccttcactttttaaggataattttgcagggtagagaattccaggctagcagttttttctttgtttttcctttctcttgaattttaaaatatttcgctctattctctatttgcttgtatggtttatgaggataagttggatgtaatcctgctcttctacaagtaaggtgttttttcttgcttaagatttatttatttttttcattttctgcagtttgaatatgatatgccaaggtgttaggtggtggttggttttgttttgccttttcccgcttgttctctgagctgactggatctgtggtttgctgtctgacattagtttgtgtggaattctgtcattacggcttcaaatattttctctttctgtattctcattatgtgtatgttgtaccttttgtataataattgtcccacagttcttattgtttttaaaaatatatattataaaaatactaacgcttcacgaatttgcatgtcatccttgtgcaggggccatgctgatctgtgaattgttccagtgttagtatatgtgctgctgaactgaacgcagttcttagatattctgttccctttttttcagtctttttaaaaaatctgcttttcagctttggaagtttctattgacatattcccaagctcagattcctcaaccatgaacagtatactaataaacccatcaaaggcattcttcatttatgttatagtgtttttggtctccagcatttctctttgatttttccccttgcttacattatcagtctattcttccatgttgtctgttttttcccgttagcatccttagcatatgaatcatagttgctttaaattcttgtctgtttattgcaatattcttgccatatttgaatctggttatggtacttgctctgtctcttcaaactgcttttttgtcttttagtatgccttgtaattttttgttgaaagctggatatgatatatcagataaaaggaattgtgatatataggccttttgtaatgtgatggtaagctgtggggagagaaaaaatagtctatagttcaatgactatatttcagttgtttagtcagccattgccctgggctgtgagcttcacaagtgcttctcagttcttttcatccccttaggtgggacagaatggttagaggaggctggagttaagtatttctcttcttctgtgtagacggggagagggaggtggagctggatattttccttcccccaggttggttaggctgtagtaagatggattttcttgagggcagaccttaccagtactatagctttacaagaactctccttgcacaggcagcagtgggtatttttctcaggtctctctctttttttttttttttgagacacagtctttctctgtcgcctaggttagagtgcaatggtgtgatctcggctcagtgcaacctctgcctcccgggttcaagcgattctcctgcttctgcctcctgagtagctgggattacaggtgtcctccaccatgcccagctaatttttgtatttttagtagcgatggggttttactatgttggtccagctggtctcaaactcctgacctcaagtgatccacctgcctcggcctctcaaagtgctgggattacaggagtgagccaccacactggcttggatctttactgtgagaacctggtagagctcctggaggtaaaaccaaaaaaagtgtccctagagtttttaactttcagatttgtctatactaagcctccagcaagtcatcaatcgcaatttaggttttcctactcgggtgctggctcctgtagagaggtttttgtctgtggatttctgctttgataaattatgatcctttgttatcaccttgtctgtctatccaattgtgggggcagtggtttgccctgtgaccttacttctctggtggatctaagaagagttgttgatctttgttgttgttgttgtttagctttttactcactattaggatagagtaacgatttccaagcttcttccccactgcgtccaccccggccaggtggagtctcgctttgtcgcccaggctggagtgcagtggcgtgattttggctcactgcatcctcccatcctccacccactgggttcaagcgattcgcctgcctcagcctcccaagtagctgggattacaggtgcctgccaccacaaccggctaatttttgtatttttagtagagatggggtttaaccatgttggtcaggctggtctagaactcccgacctcaggtgatccgcctgcctgggcctcctaaagtgctgggattacaggtgtgagccaccgcccctggccattcagaaggttttaatttggattcaggcaggcatccagggaataggtatgttcttaccttatttatatccttggtcttagtctagttccctgtgtgttggtattgcattactgatactgttatttattatgaaagacaatgtacctgcagtaagctgatactgttcagtggactggactgattttgtttaaaaatccttatagtgagactgagctgggtaagtgaacccatgttatatcagtttatatataggaagtttgaagtggatgtgaaagcagtataatgaattcataactgttttcaagctttcattaatttatttttgatagacacataagtgttagagaactcggttgtaaaataaggatatgaaatctgttttctatataaataaatttaacatttttcttttgaagcctaatcatgagcagacaactgttagtaatcttgaaagtgaagttttctgaaatgagtctcctagagattgtgggaaaaaaaaaaaggtggtatgtgcatggagataagcctgcaagcatgtagactgtactgtttagtagaattgaagatgactgtggaagtatgtatgtttgtttgaagaatggtggtaaaattgtttgtaagatgttatatatgtagaagatgagaaacaggaaaaaagcatactacacagatgtcaaaacccatagcactttatagcagaaagcgtggaccttaatgaatacgaattttaaaagaccatcttttaggaggctgggggattccaggatggaatgcagattgagacagaagaatctaattgtattagagatgtataaaacaacctcattgaagtgggtgatgggggaaaactgttgatctaattaattttggagatgcatagtgcctgtaatactaaaggcaaaaagcactgcacatattctttacttgtagtgtacattggttgataatattgcttcatataaaggtatagttaacaattctgatactgcaattctgatacctctagtaatgtatactaaacagttaagtataagtggatggtggattgtggtagccagatttctcactgttggaatggaaagttacaagcaaggagaaggaggctagagtgatccatgtggtaaaggattagaattggagacatcagcgtttagtccatgtttagcttactatatacagtgtacactttaaataaggttagttgattaaccttaaaacaatgaaaaataatctcagccttggaatttatacccattaaaaattaagataggagtagtagaaaagtataattaatatttttagcatttgatttaaaaaatactgtaggatttgtcagatctcacagactgggggagggtgttaggcccatacctatgtattaccagtcatattgttgaatgaccctcaagatgaaagattgtattgatataaacaagtgcagattccttcatcataagagtagtggttgtattttacagtatttgtaattttatgtaaattattgtttaaatatgtgcggtatggttctaccttagccatcattcccaaggggaaacacagcaacaaggtttcagtgtagctaatacttgtgcctaattttctgttaaacacttggtttgtggcaagacttgtaggatgttcatttcccagtcattctgggaggctcagataaatgaccatcacatgcatctaaaaggtttgggaaaattcaggtcttaggtcctggtttttttttttttttttttctgatgaaatgaagaacttgagtgaaataattagggaggtatttcttaaaatccttggaacatctttataattgttactattcttaactaatggcctgtgtggaggttaccacatagtctgggaggatgatttaaaatattttattttggtgttggactgtgtcatctataattttggcttcagagaatagagtaaaatataattgagatttaattggtggtttttctgaattggtctaggagtgatttgctaaatgctttatatacttatcctagaaatattcgttagtgttatttttaggattgtatatgtaacttttattactatacatttactatgtattttctgatgttataaagactaatgtaaggaaagatagtattttggttttattctcttattacagtgcagattccgattctgtagatgtaggatggagcttgattggttcatggaccacacttttgtcataagtatgtatatataggaaaaaacatagtatatatagggtttggtactctgcagtttcaggcatccaccgcgggtcttggaatatttcccccgcaagaatggaatctttctttctttctttctttttttttttttttgagacggagtcttgctttctcgcccaggctggagtgcaatggcgcgatcttggctcactgcaacctccgcctcctggattcaagcgattctcctgcctcagcctaccgagtaggtgggattacaggcaccaccacgacgaccggctaatttttttgtatttttagtagagatgaggtttcaccatgttggtcagtctggtcttgaactcctgacctcaggtgatccgcccgcctcgacctcccaaagtgctgggattacaggtgtgagccactgcacccggccgtgatctttctttatatatagaggattatcgctataaatatataaaattgggtgccaaaagcttgaaaggttatagtggaaatttgaaaatctacttttattctcacagatgtgtgtatttttacttagtaaaatttactgcttagtaaaatttaagcagtacttgtgaacttttcaaatcccccttcccaatttgtagagcttttgaaggaaatgtggaaacccattgtgtgagaaggaattttagttgttactttgttcccctatatggtcttgcacagtggaagggtataagtacataaagcatttagcagatcactcctagatcaattcagaaaaaccaccaattaaatctcaatcatattttactctgttctctgaagccagaattatagatgacacagtccaacaccaaaataaaatattttaagtcatcctcccagactatgtggtaacctccacacaggcgagtaccaactggggcttaatgattagctaatatttagggtcagtggttaatgagttaaatacattaacaccagctgtgcaagaatagaatgctatggataaacaggtgcttgagaacattatgttcctcttcactggttctaagccctgtgtgagtgcattagaattccttgggaagctgttaaaaaaatattgattcctgagttcgagcccagaccaattgaatcagaatctctgatgaaagaacccacataatggatattttaaaataaatttcttaggtcattctcaagtgctgccagggttgaaattttttgttgtaggtatttcatgatgttgctgatgctgttgatgctgttattttgtgtgtgtgtgtcagagagggaagaggggggaggtgcatagtcttaaacatgctaaagcaacaattctagtttcttaatattcaagaactggttatcttgtcatcattatgtattgatgattattgggttttgaagttatgaaggcatgggtgaaccaaactgttcaattgggttttctcttacacttcattgtttatggtgatataaatacaaaagtttaatgttaagttggcttttgcatctgtaataaattgttccttttatatcagtttgcatcaagatgttgttttaaatgtgtgtacagaaagaagggtcaggatgtgatttagctgacagttttctgctaaccagtctcacgaatattgacattggttcttaaggagagaggggtcatagtagattgtgggaagaactgagactgcaaacatgccacttgtagaaggtagggagttgtaagatacgaaactttgtcagagcaagggttgaagttactttatctgaactttaaagtgatgctttgggatgccgttgtgatctaagaatatgtgttaggctgggcgtggtggctcatgcctgtaatcccagcactttcggagactgaggtgggcggatcactttagctcaggagtttgagaccagcctgggcaatgtggtgaaaccctgtgtctcctaaaaatagaaaaaattaaccgggtgtggtggcgcactcctatgctcccatttactcaggaggctgaggtgagaggatcgcttgagcccaggaggtggaggttgcagtgagctgagattgtaccaccgcattccaacctgggtgatggagtgagaccctgtctcaaaaaaaaaaaaaaaaactaagaaaaatatgcgttagtgttcatagtcttaaataatagaaatccctctactttaatcataaatggctttgtgattaaagaggatattgggctattcatagaatttcctaaagggtagaagaaccagtcttgtgcaggaacagtgtgctacgtactatactgcagagctggtccagtgaaagcatcactgttaggtgacatgttcacactatttgtactttctctgacataaggtgacagatactcctaaaactgttgtcagtgttcccttttaaaactggatgaaggaagaattttttttttttttttgaggcaggttctcgctctgttgcccaggctggaatgtagtggcatgatctcagctcactgcaacctctgcttcctgggttcaagtgatcctcctgcctcagtctccctagtagctgggactgcaggcgtgtgccaccacacctggttaatttttgcatttttagtagagacagggttttaccatgttggcctgtctggtctcttaattcctgacctcaggtgatccgcccgcctcagcctcctaaagtggtgggattacaggcgtgaaccaccgtgcccagctggaaggattaattaattcaaactggagtaaattagctgttgctgttgccttcaacctcaccagaatggattgcttatggggcttgcttctgtcgctgcttcctctttgacctctacgtcctcctccttttgttgattcagtttttcaaagtcggggttggtttgtctgactggaaaagctcaggacttacacgtaaccctgtcccagttaggagagagatgtggaaagcaaatacctggttttcagtttctttagttttagggcaaggttctgccttataaagtgaagaattctccaaacataggaaagtggattcgataaagctgggtagccccctccagtgccatatatccatgaaagaacattttgtgaatgaaagggaatggttacaggatttgtggatatctttgctgtgatttgagtcttgtttgtattttttccccctttctaatgttgaaaaatgaatgaggtgcaatggtagatacaaaagcggaggacagttggcctgttggggtggctcacgcctgtaatcccagcactttgggaggctgaggtgggcggatcacaaggtcaagagaccgataccatcctggccaacatgggaaacctcatctctactaaaaatacaaaaattagccaggcgtggtggcgggcacctatagtcccagctacttgggaggctgaggcaggagaatcgtttgaaccccgggtggtggaggttgcagtgagccgagacggtgccactgcactccagcctgggcgacagagtgagactgtctcaaaaaacaaacaaacaaaaaccaaaaaggggtagacagttaagagtataaaatttgtaactaaagtgggccctacaagtaatctgttgttattttattgtatttgagatggagccttgctgtgttgctcagactggagtgcagtggtgagatctcggtgcgatttcaccatgtcggccaggctggtctcaaactcctgacctcaggtgatcacccgcctcggcctcccaaagtgctgggattacaggcgtgagcaaccacacccagccccacattgttttttaaacttgctctaccatttttatatttccactagcagtgtatgagggtttcagtttctctctttcctgcaatatttgctattctttgtctcttcctggttttttgttttttaaagagatgggggtattgctctgtcacttgggttggagtacagtggcatggtcatagcttactgcagcctcaaacacctgggctgaagtgatcctcccttctcagccttctttgtagctgggattacaggtgtgagcctctgtgcctggccctctctccttttttaaaaagttataaccatcctagtgggtgtataggcatgtcttattgaggttttgatttacatttccttactgactgatgttgaacatgttctgtgctttgaccacttgtaaatcttgatttgtgaaatacctattttaaaattgtatagtattattattattattattattattattattattattattattgagagagggtcttggtctgttccccagcctggaatgtagtggcatgatcatggctcattgcagcctcaactccctgggctcaagcgattctcccattttagcctcctgagtagctgggaccataggtgggtgacaccacaccaggcaaatttttaaatttttttggtaaagatgggggttctcgttatgttgcccaggctggtcttgaactcctggactcaagtggtcctcccactttggcctccccagtcgctgggactataggtatgaaccactatgcctggtaagtccttttattattgagttctaagagctctttatatattctggaaaccagacctttgtcggacatacgatttgcaaatactgatttcctgttctgtgggttgccttttcactttctttgtggtatcttttgaaacacacatataatggagttttgggatgaagtctgatctgtttttttcttttgttgcttgtggttttagtgttatatctgtgaaaccattcttttaattctggatcatgaatatttactcattgtcttctaagagttttatggtcttagcttttacaatcaggtctttatcgtttttgaattaatttctgtatgtcctttagaggtccagcttcattgttttgcatgtggatatccagttatcccagcactatttgttgaacagactgtttttccccactgaactgtcttcacatcctcattgaaagtcaatcgaccataaatataagggtttatttttggattttcatttcttttaaatttatctagatgtctgtccttatgctagtatcacactgtcttgattactgtggctttgtagtatgtttagcaatagggaaatctgagtccctatagcttttaaagctaagagtgtctcgtaaagcagtggtcccttacctttttggcaccagggactggttttgtggaagacagtttttccacggactgggctggagggatggtttcagtatgacttaagcacattacctttattgtgtaccttatttctattattattacattgtgatgtataatgaaataattatataactcaccataatgtagaatcagtaggagccctgagtttttttcctgcaactagatggtcttatctaggggtgatgggaaacagtgacagatcataaggcattagattctaataaggagcacgcaacctagatcccttgcaatgcgcagttcacaatagggtttatgctcttatgagaatctaatacctccactgatctgacagaggcggagctcaggcagtaatatgaacgatagggagcggctataaatacagatgaagctttgctcacttgcctgttgctcacctcctgctgtgtgacctggttcctaaaaggccatgaactggtagtggtctctggcttggaggttggggaccccagttataaaggatttgtgtttacatgatactgtattttatgaaaggcagtctggtagcaataggcaggatactagagccgtgagaaatgaggaaccaaaagcagagaaacaaattagaaaggctcttatatgtcatgctaagaagtttgggattcatgctgaaagtaaggaaattacataatcccagattgcaggggcagggggagggagggggagggtgtgtgggaggggatgtggtggtaatataatcattaatttcagagtattctggaaaatggccttaagggtaggggatgggaagtctggaaagaggctgtttggattatccgttagttttattggggcttgagaaaacaacctttaacaaagcttttcttttctttttttttttttttaaattttaagtacagagagaagaccacatccaagaaaaccctataacaaaatatcagaatttgtgaacaactgtcattctacctaacggttgcagaaactaaaaatcctgagtcattctaggcccccacctcctcactcctcacatttaatcagttaccaattcttgtttattctgccttctaagtagctcttggatttgtcttctcttctcaaatactatttacattgttttcaggccctcatatttttcagctgaataaaaagtataattggctatattattatcattttttaaaacctcaaatttaaatcattataaaacaatgttgcattatggccattgtgggtaacaaagtcactttgaaatgtgctggaagatccaggacattcagaaatctaatagcttttggcttatgatagatagaggggtctccaaatctttctgtcttctccctgtttgtgtgtgtctgtgggtggatttaattaagacagaagaaagtgaagtaaaagtctgttgcagcgaattaggaccagaggagaggtatagaagaccataaccgctttgaagattttgaaaaagatgaagcaattaggcagatacattagtctatcacacaaatagatcattattattattattttttgaggcagtttccctcttgtcgcccaggctagagtgcagtggccccatcttggctcactgcaacctctgccttgtgggttcaagtgattctcctgcttcaacttcccaagtagctgggattacaggtgctcgccaccatgcctggctaatttttgtatttttagtagagacggggtttcaccatgttagccaggctggtctcgaactcctgacctcaggtgatcctcccaccttggcttcccaaagtgttgggattacaggcatgagccaccacgcctggccacaaatagattcttaaaagaaaactctgatctttaatacctgaaaacactgtctactgaaatcttaaatcttagtccttggccaggcacggtggctcacgcctgtaatcccagcactttgggaggccgaggcgggcggatcacctgaggtcagaagtttgagaccagcctggccaacatgtgaggctgaggcaggaggattgtttgaactcgggaggcagaggttgcagtgagccgagatcgcgctattgcactccagtttgggcaacaagagtgaaactccgtctcaaaatgaaataaaataaaataaaataatcttagtccttactgattaaggccattagtaatagtaaacaacagtactgtttttatcagactatttttattattttttttcattatttctgcacagtttgctgtcccctcaaatctcagggatcagtgggagaacctgtgatatttatttccctgtgatgtccttccctcctcaaacttttccttattaggaagtgtttgtaaaaatgttaactttatgtttatttgtaaggatgtcagaaactgcaaataaaaatgagttaccaaaacaccaggggtttggtctaggtcatgctgctcactgcagagaaagccagtgactgagacaacaagtattgccatgggtgctgcagccaggaagatgagaactcagtctcaaaccatctccctgagtgactaaaacgaagggttcatatagcagggaagaaatgtaaaagaaacaggaactaaggcgggccaaggaagcaatcatgatgaatgagttgtctagcatcttattgtctgtctgaatgtggtgatctggtgagtttcagttatttgatactttgagcagcctgaaggtcatttcctgaggaaggaactcaggtaaaacaaatgtaagattcaagctttaagaccagaagggtcaacttctatgtttatccaaaacctatctagggaactaatgggttggtttcaaatggagaaaacgcattccatattcccccaaccaggaaaactattttttctatgcttgcttacagaaataggctctgatagttaaaggaaaaagaaagttctcacatgacttagaaatttcaaataaatgcaaccaaaagattagtcttagcatattttacaaatcagatcatgaattttaagcttttgccttttaagaattaagcttatgtatttattttgcaggaatgtgtttatgatgattaaagacttcaggttcttactatataacatagttgatttatgagatatctgaagaatgggtttttagtaagctgactgggcctttgaatggcacattgtattcacctgttatgaaaaggaagcttatctttactggtaagggggtgttaggtttaacataaaggaagtatttgtatccagtgcttgtaaatattaactgagatgttttattaaagaataaaggaaaatttcctttttcttgttgagtaaatgctattttgtcctaaattttctcttgtaatatacctgcatccaataaatattcttttacttatgacatatttttgaaaatgtgttttgagagtggggtgctgcttggcttcttggttggttactgttataaaataggtattagcagggagtttagatgactaaaagaccccatggggtgggtaatggtaaaagtctaagagaagatgataaatatgaagaactgtcctgcaaccagatcagagcagaagggtcaaagccagtaggaaagacacttttcttttatataaagtgtcttactttaatccttacatcaactagtgaagtattcactttgcagatgaaaattaaaactatggtcacatgattatccaagactggtattaatagagctaatgttaaatctatgagacattattggtgtaaaaaatagatattaaacaagtagattaggaaaatactgtacgttacaatttgtaacgtgataaaaggagtgggaatcaagagggaagggacgtcatactagaagaatttaccgttaggaaagaaaaaatcagtttatatcagtatctcatgtcatacttcagatacattttagatggataaaaatttttaagtgaaaacttaaacatcaaatgaaaacgtgaatgtttaatctttgaagagagaagggctttttaagcatgaaagcaatgaaagaaattgcaaagaaaaatactgattcaaccaaattttgattcaagcaaaaaaagacaaagaaaaatatttgtaacagatatattaataatagagttagccttgatatataaaaagtgcatacaaattaataagaaaaatgtttaatccccaatagctaaactgaaaaaaatagtaaatgtttttcctactttgtctctaaaaggatttaagatgttttaggaagatataaaaaagtgatgcaaaataaataaatgtattaattttataaaataaaattttaaaattgagatggaaatataagagtatacatgtaagatgagaccaggagtgaaaatatacataccaaaacatatgtcattaattcccatatacttccacacacatttgattttaagccagattccttagggaagaaagtatcaggtatgagttaatgtcctttagataaaagctgttcactgaaaaaaatatttactccagatgatgaaaccagtttcttcccattagtcctctaaagaagctgctatatgatataatgaaaaatatattcaacaatatctttataatatccacagtgacacatttctttggcatttgtccctgcggcatctgggcaaagtgcaattcagttaaagcaggtgaggtgagctggataagttctaattctcaagaccaagaattctcaaggtcaaggacaaaattttcctcagaaactaattttgatgtatttattagaaaggtagttgaagttctcatagagcatgactgaaataaatttaccttaaaaaaaataaaattctctctatgagaccatttaatgaaaaagtcagtgaagcatatatagcttccagatttgagtgacaggatattctagtataccttctgagacaaactagttgcaaaatatataaagagactgattatatagaatcatgaataaaccagtgaaactataagttttgctatggaaatctgtatggtggggacacaaaggacagagtattcacttttacttggcaggggggcggtggggatgcactattttagggtggtgcttgttagccgagcagttgttggctagagggacaaggtgtggaagtgggtaataatttttagtcagtagaaatattatgtgacaggctctcttcatgcttttgtgcattcaaagaaaagcagctcataactggagcatagtagaataatgtaatcattaaaataaaattttacctgtatttttcaaggatacggccttggtaataagacagatacaagaggtctcacgagcaggtgagtgcagaccattattaaatatttgagtgctgactgtgtacttggcattatgctagattgttttaggataggggatacaacaaaaaataaaacaaagtccttgttttcaaggacctggaatctagagtggtgaaaacatatgagtaaacagtcctaatactgtatttgaaatgtacagagatgtagtttgtacctggagcatagtatcagaataacgtgcaggagcacagaggagagtatgcttgaagggggcattcctgacagttaatatttcatttttattaaacttagaggcgctcaaaatgcatcacctttgattctttggaaagaggaatgacgtataacagcaattttgaaaaattactagagttagcattttctttgatgatagttgggaattaaattgatgtaatctgttacccgctttcaggttataatctttatcttctagtagtggtttaccaatgttatttctgaattaaatatattctttgcattatgtccactaactttttaaaagtaatcgactagactgggtgcttaaggctgttcatgaggttcttattttctccagggcaaccagtttatacattcagaatttcatgatgatgcatactgtcacaagcaagtaattaggtagaattattatccctattgagggacaggtaaaaacatgggatgacaaagccatccctactctggatacggaaggaaaaacagtgaggttaggatgcttcagttcgtccgtatttgaactcatcatcttaccgtcccaaaccatgtctatctaattccattccagactctctttttttgagacggagtgttgctctgtcacccagactggagtgcagtggcacgatctcggctcattgcaacctccacctcccaggttcaagtgattctcctgcctcagcctcttgagtagctgtgattacaggtgcccaccaccacgcctaactaatttttgtatttttagtcaagttggggtttggggtttcaccatgttggccgggctggtctcaaactgctgacatcattagccgcccatcttggcctcccaaagtgccgggattacaggtgtgaaccactgcacccagcccagactcttttatctggttactgtatattctctgtaaaaacaaccacagaaaccaacctgctaacatgaatgctttcactatcctcttttattaatttctacttgtttttaaaatatgataccaacacatgatcaagtagaggggaagtgcagaagtaggtccgatttcttcacaattctttttttcttttcacttctattaggaagcagaaatccgtaaattcttcaaactcctcttcacttaaagcctaatctactaaccggagtaagagaggaacatggggtcaggaatcaagttcaggggttagtaacaggaagggtgtgaattttacacaacacttttctttttcacattaaaatcagaactattttcactggctgcattttcaatttgataatgatgtatgtgatttttgaagtttcccccaaaataaatttgatggcaacaaaatgtttttgaggacctgtggctttttataggtcctttcagagttacttacatgtgtcacattaatgttcttagaattagcatggctcaacacttctggattgacttagtttcatatgcaactcgtaattgtgatttattttgccctgttactgtagaccaacttctttgactgttaatatgctttttactttatttaccttttctaaccaactttcacttatttttacactgattttcctgttattctattgactggtggtctggatacagaaggaaaaacaatgaggtgaggatgcttcaattcatccatatttgaactcatcatcttgctctcccaaaccacatctaattccatattatgttgaatgacaccaatacacacacattcacatttgtaaatcttgggagccatcctagtctatcctttctcattcctctttcatattgatccagtcctcaacttctgttgccttcattagttcttatttggaatatttcagttttctggctttttcttgtttcttcttcctctagccagtccctcaatgttattgtcactggagtccaagtttcttagtatagtaaaataatacacgtgggatttctttcattgtcaatgtacctcacgatatgctacagctctatggatcttcttgctgtttattgaatatatcatgacttcatatgctatgtcctcttcctggaacactatttcccattttggcaactgcctaagtaaaatacatactttctctggtatattttattgacaactcttacattcattgacttgattgggtgtcacttctctatactctcagagcctcctgtttataccttcctcaatatacttgccactccttgtctacattgcgaatttcgtaagggcaatagttttgccttgcttattttcatattccctgtatcaggcatggtgcttagctcctaataggtgctcaccgctttaataggtgttcaaaaccttaagaaaattgaataatatattggtaacttaaaaaatactttttaaaaattttctgtgtcctaatcgctttttcggttacatttgtaatgagctttttaatttaaaagttaatgaaaatgtttagtatttatagatgaaatctattcctttatattttaaatatttgcacaaatgaaggcacatctgtaatctatttaaaaatgctaattttcgtcaagttctcatctgacaaatgccttagtttcacttattgtagttggaatctttatctgggtcttatccttgaaaaaacatgacttgatttattttttagggttgaataatgaagggattatccattagctttggtacatagtggcatgcaaatacttttattcattactaaaatcttgttaggttgactcactcatttgtaacattttatttcaccataaactagacactgagttacaaagttaaatgcttagattagttacagttaggaaacctacctaaattatattgtacaagaaagacaatagcccttattgcattttctgtctttatagtgtgcaaattgcttctggtcagcccagcctgtgatggcaacatttcaaactttgtatcacgtaatctcaagtaatgcatgttgcacacacggcgcagagtatagattagtagatattgcagtgagagtaacttcttatttctctacacttgtttgtttaaagatactggtagttttcattttatgtattaatagagaaaagatgggaggtggctaatgaagtgtgctgtggacttgtttttaactgtattactctatcaagatggaaatatcaattgatttgtgtattaaagatatcctgaggagaaatctagttcatatattataatagacataggcacacaaaaccatttcactgtttctggctgtccctatgcttaggttattaaccttttgtacttctttctcttcttgtagcatctcatgtgtcttcctttacccatttcagtgtgcactgagttgggggttagaggagaaattgaaaatggaaagcacaaggtctggattcatctttatttaaaaaagaatacgtgcaatgtgccagtcattgtgatgtggtagtgacacctagtctttacctttgagttctttatagtttatctacaaactctgataagtactatagtatataacaaaacctgccaagagctcagaagagggaataactttgccttagtaagctgggaaaggtttctaagaaaagttacctttgaattaacttcttgaaatagtttatgtttcttattcacgttttaagcaactttactgagttagaatttacatgcaaaaaattcatatttttttgttgattgttaaatgggctttgataaatacacctaagacaaacgttcattactctactccagaaggtgccttaagcccctttacagtcaatcccttactcctccccagtaactgtgaatctggttttatcatcatagattagtctttttgattttacatctatagcttcatataatgggatcacgtagtaggtactcttttatgtgtggtttcttttgttcaacataattttaaaaagtcatccttgacattgataagtagttcttttatgttgctgaatagtattccattgtatgaatatattatattgactggattctggattctgaccgctccctgggcttgttgccattgttgtgtgtttttgtttaatgactttcctggattacttctgtggtctgttttccttttaaaatatttcttatgcctggctttctgggggattgcctctgtgtcactgttatcttagtggtcagctaatgattgcttaaaggttgttcctgaacaccagcaagttagtgttaccccattttcctgtggacctgtttatggtttggagaatgtcttaaaattttaggcaatttcaaatttgacccatgttcagccagagactagcttgcaagtgttctttctggtgtagcgttacacatgcagacagccttcctgactactaagcatgaatatccacttaaggctcttcttggcagtctttttcctaggatcttcctgttagatttctggctagtttgctattttgttgcttgcccccaccagagtcagttagataatggccctcgtgatgcctgccactgaaagcgttattattattaatattattattattatttttttgacggaatctcaaaagtgcggtggtgcaatcttggctcactgcatcctctgcctcccaggttcaggcgattcccctgcctcagcctcccctgcctcagcctcctgagtagctgggactacaggtgcacaccatcatgcccagctaatttttgtgtttttaatagagacagggtttttaccatgttggccaggatggtcttgacctcttgaccttgggatctccctgccttggcctcccaaagtgccgggattacaggcatgagccactgcgcccagtccactcttgtttttaacaacattcctgggtacagatttttccatgcctcgttccaaataaggtcagtcccctcttgcagggaaaggtagctaccactctttatggcctgccatgtttgcccacagtagaatgtttatgccacaaacctggcagtatagatggggataggaatagcccctagctaaaataccacagttcttattgagatgcggtgtatttttctggaataaatgcttctcattttgttgtatgacctttggtcagtttttggaggctttggtggttagatttgaccttgtttttttttttaattgcttaagggagagaatttgctgaactcacagagcctattggaagacctggcctcaggattttttttagttttcctctagttttttcccaaaccgcaggcatttttttctccctcctgaaaacacaaagccagtcatttcacctccaattttattttattattattttttcattttaaaaaatagagacagcatcttgctgtgttgctcaggctgttcttgaactcctggactcagacagtcctcctgccttggcctgccaaagtgctaggattacagcatgagtcaccgtacctggccatcacctttaattttaaaagtcttaaagtgcctttgtgttgttctcagaataaaaatgaaaaattcttttttttttttttttttgagatggagtctcgctctgttgcccaggctggaatgcagtggcgctatctccgctcactgcaagctccgcgtcccgggttcacgccattctcctgcctcagcctcccgagtagctgggactataggcatctgccaccacgcctggctaatttttttgtatttttaatagagacagggtttcaccgtgttagccaggatggtctcaatctcctgacctcgtgatctgcccgcctcggcctcccaaagtgctaggattacaggcgtgagccaccgcacctggccaaaatgaaaaattgtaacatggtctggtctaccttcctatatatagtcatgtgtcgcttaacagtagggacatgttctgagaaatgttgagtgatttcatcattgtgtgaacatagtgtgttacacaaacctagatggtacagcctgctatacacctgggctatataagatagcttattgctgctaggctacgaacctgtacagcatgctacgatactgaatgtggtggcagtcataacaccatggtaagtatttgtgtatctaaacatagaaaaggtatagtgacaatacagtattgtagttttataggaccaccattttatacatagtctgttgttgaccacattgttacacagctcatggccacagttttatcctgtattaatcttgtccataccgctcattctgggtagtgtttgactgttgtccccaatctagggagcattttgctttctcttctttaaaaatcaaggctctgacccatgacatacacatagacttcagaatttaagagatgtaggtttgaatttctgttcttcatttattagcaatgtgactttgagtgatgtgcttacatttctcagttttctcatcaaaatgtggtgatgaacaaataatattttgtagggttgcttaaggcttaagtaagataatgtatgtgaagccattagcacagtgccttgtatctagaaggtgtatttattcccctacatgatattctcctcatcatttctttgagtaagcagttcatatgaaatagtggagacatcagtatgcattaagtagattcatttcagtattaccattccaccgattatttgagtaaaacttatacctgaatttcatttgggtttcaacacatttattaagtgcctgatctgtttcatagcaccctcattacctctttttttttttttttttttttttttttgtttgtttgagacagagtcttattctgttgcccaggctggagtgcagtggcacacaatctcagctcactgaggcaacatccgcctcctggattcaagcgattctcttgcctcagcctcctgagtagctggggttacatgcacctgactgatttttgtagttttagtagagatggggtttcaccatgttggacaggctggtcttgaactcctgacctgaagtgatccacccacctcggcctcccaaagtgctaggattacaagtgtgagccaccactcctggctcctcattaacttttgaaaatatgcttttaagagaagtataatacattaaagagtttttctatttttttttctttttttcttttttgagacggagtcttgttgtccaggctagagtgcaatggtgtgatctcggctcactgcaccctccgcctcccaggttcaagcgattctcctgcctcagcctcccgagtagctgggataacaggcacccaccaccactcctggctaactttttttttttttttgtatttttagtagagatggggtttcaccatgttggccaggctggtcttgaactcctgacctcaggtgatccgcctgcctcagcctcccaaagtgctgggattacaggtgcctcgacctcccaaagtgctgggattacaggcatgagccaccgtgcccagcccaagagagtttttcttttacatcaaagaaaaatttctttttctgtaatgagacttttagacttctcattttttattttgaaaagtcttcaaacttgtggaatagaagcaaaagtagtatagcaaacccctctgtatcctaactacaatacaattagcatatttaggaaattaacattagtacagtactatgcaatttgacactacatcagttttgccttttctccccagtgatcatagcatttttttcttcctacttcatcagtccaagatcatacacttgatgtagttatcatatctctttgctctcctccagtctagattggttcctgacccccccctcctttttttttttttttttttgacttttatgacattgatattgtcaaagaccaactgttttgtagtgtctctcgacttgaatcacactgtttcctcataattttatttggggtatgcattttttgggggcaggaataatatgcaagagagaccgtataaaagacactatgttctgtaaaggtatatcacatgaagaggtatataatgccagtttgttcccttattggtgatgttaatttagatgactcagttaaggtggtatccactgggtttattttctctaaagttatcactttcttctttgttgttaataagtaatctgtggggagatacattgaaatggtgtaaatatcctttttaccaatacattttgattcagtggtttttgaatccttgatgatagttgtttgaatcaggtattaccagggcagttgcaaatggtagatattagaatttcaaaatacaatttctaagagttttagtgtccctaaaatgaggtgtttttttgttttgtttgtttgtttgtttgtttttgagacagagacttgctctgttgccaggctggagtgcagtagcacaatctcagcttactgcaacctccgcctctcgggttcaagcgattctcctgcctcagcctcctgagtagccaggactacaggcacacaccaccaccatgcccagctaatttttgtatttttagtggagatgggtttttaccatgttggccaggatggtctcgatctcttgacttcgtcatttgcctgcctcagcctcccagagtgctgggattacaagtgtgagccactgcgcgcggcctgagctttctttaatagtaataattacagagtatttgattgatatctgctctgtcatggctttaattatttttatgatttttaggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggtaagattacaagaattagaaaaaacttttaagaaaactcgatgaagccttgatacattacaaagcctaattttattaagaaatatgtttatttttgactaagtgccagaggggaagaagaatagtcttttagttagctctttaaaagtgctttaaaagtaattacatttatcatccatcttgatagcatttagaatttacagactgtatttcctctttccttactctgagctaacttagttcttcagtggttctccaccaggggtagcatctttactgcctttgtttggaaatgtgtagagaattttgtttaacccaaggactgggagtgctactagtattttagttccggtggtggaggggaggtccaaggttgctaaacatcctgcagtgtgctgggcatcagtacaacaaagagtgtcccactcaaaattaccagtaaagccccaagtcctgctaatggaactttgataaaactctacactaggacggggtttggccaagattttctgtaaaggctcagatagtaaatattttaggcttatgatctccggttcaactacttctgctactgtagtttaaaagcagctatagtaatgcataagggaataggcatgactgttgcagcaaaactttatttatttatttacgtatttattttagacagagtctcaccttgtcatccgggctggaatgcagtagcgtgatctcagctcactgcaacctctgtctcctgggctcaagcgatcttcctgcctcagccttccgagtagctgggactataggcacacgccatcacaccgggctaatttttgtcatttttgtaaagatggcgtctcaccatgttgcccaggctggtcttatgccctgagctccaagtgattcaccggcctcggcctccgaaagtgctagaattacaggcatcagccatagcacctggtgtaaaactttatttgtaaagcagaatgagcctgtgggctgtagtttgctcatctctggacaaggagaaaacctactgcatataccatacatttcagtgttcaaggaagacaaagtctgtaaaacataaacatggaatttcttctcagattatgttcagatttttaaagacattttatatttggattcttgtgttttaatgataattttggtttttgatctcaatctgagacctcaccagatgagagtttttggtgactgtaggattttttcaaagtataataaacatttgtcaattacctgaactaagaataaggaacatttagaagtattgaaaaccaggaaagatataaagaattcagttaaactttttgtaatcatggagttggagtattttttgccttctttcaaaaaagagtgaaatgacatataacaatgtggttttaagtaaatttaaatgtcaaaaagtaagtatatgatgaatatagaaacaactgctgtttttgacctcaaatctggctgtgagggggagtctaggaagatggatgtggccatgtcatagtttttttgtttttgtttttaactaaaacctacagaaactagatagcaaatccaaaaacatggataaagttgactatagccttagtcatttgaaagcacaactagataagggcaaaccaccaacagccacaagacctccatgttatcactgtctatgcgagagtaagcagggagatttaacagggtgtctcataagacttgaaagcaggggaacgccaaaatagccacagctatttgctggacaagatggtgggttattttaagaacagcagctgaaataggagggtgggagggttgcccactccaatattaggcaagtgcagtgtgactatggtaaagacagaagaagctagagcagtctagccccaacgaactctcaaaatggaactactgaaatgaacctgccagagtgctcatccaggacagagcaccacactgattaaaacaaaattgaataggatagaataatccaaattgagcaggatagggacaatagaatagagtaaaacaggaggggaaggaaagagaaggttcagataaagatgggaagatcaacggctagtagatctcagaaagcaagctactaggtttttgaacattatgtgaaaacaacagaggaatgaattctgtgacgttagaaaaactaccttgaactctacattattttaaaagttcaggaacactaattttacgtagacaagagaaacagaaaagtatcaaggtaaaatcccatttaaagttattataaaggaaaaaacaaaagctcttataaataaaagcaccccagaaaaacatgaccacagaacagatcaaatctctattataaaatgagctggagaaggaggaggctgcgaatcacttataaatgacgtggaagcaggactcaaaccctaagttccaggagggtgagcaagtgctgtgctttcatgggctgcttctttatgaagcaaaatgtgtaaaggttgccataaaggacaaacaagtaaaatactttatatattacagtggttggaataaaaattgggatgcatgggttccagagagcagagtactcaaatacgtggacaccaatttgcagaaacaacttcaaaaagcccatcaggagcagtatgcagaggggaagatgagaggggctgccccaagaaagaagacatctggtctgcaacagaaaatgttgaagtgaaaacaaaaaagaacaaacagaaaatacctggaaatggagatggtggcagtaccagtgagatgcctcagcctccttggaagaaaagggcccccgggtagatcctactcttgaaaatgaggacacattcatgaacagagttgaagctaaaaagtgaagattcctgaagagctgaaaccatggcttgttgatgactgggacttaattaccagacaaaaacatctcttttttctttctgccaggaagaatgtggattccattctccaggattatgcaaattgcaaaaaatctcgtggaaacacagataatgagtatgctgttaatgaagttgtggcagggatagaagaatacttcaatgtgatgttgggcacccagctactctgcaagtttgacagaccacagtatgctgaaattcttgcagatcaccctcatgcactcatgtccaaggtttatggagcaccacatctactgatgtacaaattggagcaatgttggcctatatacctctggatgagaagagccttgtgttttttttttttttttttttttttttttttgagatggagtctcgctctgttgcccaagtgggagtgcagtggcatgatctcaagctcactgcaacctctgcctcccgggttcaagcgattctcctgactcagccttctgagtagctgggattacaggtgcgcaccaccacgcccatctagtttttacatttttagtagaggcgggatttcaccatgttggtcaggctggtctcgaactccttacctcgtgatccgcccgcctcagcctcccaaagtgctggaattacaggcatgagccaccgtgcctggccgagccttgttttattactgaattatcttcacagttccctaaagtacctggcaaagaattctgcaacattttttagtgcccagcaattatgaatggctcctccagagaaccatcagaaagctgtctgagagacgctctcactcacttatgtttggatctctgtaaacacatttttgttcttagtctttcttttgtacaaatgatgcactttgaagatgttattgtacaacaattgatgttttcctgtttaattttaaacagagaaaataaaaggagtaatagctccttttttcctatcttaccttttttttcacttcaaagttcctgccagtgtattcaacaatggacaacagagacacatgctatagagtgttttattgcctagttgacagagctgcttttgaatgctggtggtcctgttcctttgaccctacgtacttttataatatgtgttcatgctatatgacaaaatgctgtgattcctagtgccaaaggttcaattcagtgtatataactgaacacactcatccatttgtgctccttttttttttttaaatggtgcttaaatagcccattctttgcaagtcatccatgttgttcctttggcatttaactttgctcaaattgttgaagaatggtggcttgttgcatggtttttgtatttgtgtctagtgcacattttaacatggtagatgagatgcattgtgtagctagttttctggaaaagtcaatcttttaggaattatttttcaaatcttcaataaattttttctttaaattttaaataaataaatgagtcaaaagtcattgaggaaccaatatgacatgtgaaaggataacataagattagaaaaattcagaaatgactcacgcctataatcccagcactttggaaggccaaggcaggcgggtcacctgaggtcaggagttcgagaccagccttgccaacatggtgaaaccccgtctctactaaaaatacaaaaatttgctggacgtggtgatgcacgcctgtaatcacaactactcgggaggctgaggcagtagaatcgcttgaatccgggaggcagaggttgcagtgagccaagattgtgccattgcactccaacctgggtgacgagcaaaactctgtctcaaaaaaaaaaaaaaaaaaaaaagagaaaaattcagaaatgaaatgatagaacttaagaaagaatttaaaaaatcacttcagaaaagaaaactagaagggacactaggttgaataaaccaaaaaacctttaaatagaggttgaaaaggaggaaaaatttaaagaccaaaaagaaatacagaaagacaaaagatgatttgagagaaaatgataaatactgaagataggcaaagaagaaacaacatacagataataagactctttggaaagaaaagcaaagcaagggaatagaacaactatgaacaactatagaaaaagtttcttacaagaagatttgtgactgggcatggtggctcatgcctataatcccagtactttgggaggccaaggtgggtggatcgcctgaagtcaggagtgagaccatcctggccaacatggtgaaaccctgcctctacaaaaaatacaaaaattagccgagcatggtggtgggcgcttgtaatcccagctactcagggggctaaggcaggagaattgcttgaattttgcagaggttgcagaatctgttcactgcaacctctgcctcttgggcacaagctatcctcccaccttgagcctcccaagtagctgggactacaggtgcacaccaccacacctgactaattttttgtatttttagtagagacgggatttcatcatgttgcccagctggtcttgaactcttggactcaagtgatccacctgtctcggcctaccaaagtgttgggattacaggtgggagccaccatgcctggccataaatttaattcttatagtaactacattgttgtggtcataattaatattgttattctgaaactttatattgttgcatcaagtaagtgagtattaggacatatattgctcctgcatatgctagattcttaatgggcaagagaggaagtatagatgtaatactgcagaggttaagtcaaactgattattccatattttaatggaaagttacttactagtatgcgcttattaggtattttatctttcaaaaatatatgtacccaactgtgtttgtttgtttcctgactgtgaacactgaagaggactagatcaaaaatgaccaattgagtagcaattgaacatttacagtgctgtgtgcagtgaacttctgtagcacccaaattgtggtgttgggaaaaaccattccaccttaaaagaaaccaagcctttctggcaaaattgctgattctaggttttgggcaagaaatgtacatgctgagctggaacattgtcataacagttagtaaggaggctgttaaagactatttagggtcatttcagaaagactggagaaatgactgtagaattcccactggccagagatcggtagaaacctgtgaagtgtgtttaaattcttgagttcataatggtattttaaaaaggaattggttactcttagattagagcatgataggaacaaatttattaccttgaacattggtaaatacaagaaagaagcaatttatcctgcttttcctatgtgagtgtacctctggctaacaaaatagtagatatgggagagctatttcaattgataaatgaaaaagaaatggcagaattgcaataccaccattttataactttggtgaacgaatgggtctaggtggtgagcgtcgatggctactaacatcacaagaagaaaaagaacagacattatttgccttctggtgtaagaacacactactgcctactattttgtcaaagggatcaattcatcatgagtctggtcaaggctgtatatcagctggccatttgtaggaaatacagaggacagagaaacattgaactgcaccatgagagtacatcagcagatctggacatataaatgaaatatcttaggtactttaacggagagattgtaaggaagagacagacaggaaaagagacttgaacgctctaccaaaaaaaaaaaaattcttagaactgatcaacaaatttggtaaagttgcaggatacaaaatcaacacaaaaagatcagtagcatttctatacacaaacaacaaactagctgaaaaagaaattaagaaggcagtgtcatttacaatagctataagaaattaataaaatacctaggaataaatttaaccaaggaagtgaaagacctcttcagataaagctgcaaaacactgatgaaagaaattgaagagggatacatacaaatggaaaaacatttcatgctcatggattggaataattattatagttaaaatgaccgtactacccaaagcaacctgcagattcagtggagtccctattaaaataccaatgacattctgcacagaaatagaaaaaaaaaaaaatcctaaaatttgtatgggaccataaaagaccctgaatagccaaagcaatcctgagcaaaaagaacaaagctggagacatcatactaacagacttcaaaatataccacaaagttgtagtaaccaaaacagcatggtactggcataaaaacagaaacatacaccgatggaacagaatagaaaacccagaaattaatccatgcatctatagccaattgctttttgacaaaagtgccaagaacatagattggggaaaggatagtcttttcaataaatgatgctggggaaactggatatccacatgtggaagaatgaaactagaaacccacctctcaccttatacaaaaatcaactcaaaatggatcaaagacctaagggtaagacttgaaactataaaactgctagaggaaaccatagaggaaatgcttcaggacattggtctgggaaaggattttatggataagatctcaaaaatgcaggcaacaaaagcaaaaaataccagatgcattatatcaaactaaaaagcttctacagagcaaaggaaacaacacagtgaaaagacgacctacagaatgagggaaaatatttgcaaattactcatctgacatgggattaatatccagaatatacagggaactcaaacagttcaacagcaaaaaaccagtttggttaaaaaatggggaaatgatccgaatagacatgtatcaaaagaaggcatataaatggccacaaacatatgaaaaaatgctcaacatcacaaatcatccaggaaatgcaaattaaattcacaatgaagtatcatctcaccctagttaccatatggctattaccaaaaagacaaaaaataatacggtcaagaatgcacagaaaagggaactcttatacactgttggtgggagtataaactagtacagccgctatggagaacagtatggaagttcctcaaaaaattacaaatagaactaccatatgatccagtagtcccactacttggcatttacccaaaggaaaggaaatcagtgtatcgagacatctgcacccctatgtttgttgcagcactatttacagtagccaagatgtggtatcaacctaggtgtccaacatcagatgaatagataaagaaaatgtggtatatatacacaatggaataccatttagccataaaaagaatgaaatcctgtcattctcagcaatatggatagacctggaggatgttatcttaagtgacataggaccaggaacagaaaattaaaccatgcatgttctcactcgtatgtggaaggtaaatgttgatcttgcaaaagtaaagagtagaataggggatactagaggctgggaaggaagagataagaagagatttgctaaaaaatacagaattacagttagaaaaagcttgagtattctataccactgtaggatgactgtacttaataggtaaaacattatataatttcaaagaggatactgaatgtttccaacacagaaatgttaaatgtttgagattatggatatgctgattaccctgagctgatcacggtaccttatatatattgcaacattgctgtgtaccccacaaatatgtgtaattattatgtaccagttaaacattttttaaaacagagactttaaaagaaatagcaaatgaaaatggggcttaagactaaactatttttctgtggatgcacacttacaaaaagcaataaaactataaaggcaagaaagtgactaatagaaaatcagaataattgttacttctatggagagggagggattgggacagggttcatgcagggccttttgaagtcgtctgggtgattcacccagatcaagtttttttccttcatctgagtgaattcgtggttacaagagtgtttgccttatagtaacttgttaagctatatgtttgttttgtatgtttttctctgtattggctttattttttaaaaaagattaaaaatagtcttgagcatgatattacctgtaggtttttttaataaagggattttatcaggttgaggaagttcctttctattcctagttcatggacagatttaccatgaataattactggattttgtccgttcctttttctgcatctatggaaatgattatgtggttttattctttattttatgaacatggtgaatttcagtaattggttttcagttgttaaaccgatcttgcatttctggggtaagttctacttggtcgtggtttatacttcttttgaaatgttgttagatttggtttgctaatattctgttgaggatttttatgtctttaatagtgaaggatattaatccgtagtctgtttttcttgtgtttatttggttttgagattagcataatatcagcctcatagagtcggaagatatttcctctttctttgttttctggaaaagtgtgtgaccagttgatacaacttttcctgccatctgggcatggggatttctttttgggaagatattaattacaaattcaatttccttgtttgttgtagatctatcagattttctgtttcttcttgagtcagttttagtaatttggtttttttccaggaatatttttgtttcataaatttgtctaatttgttggcataaagttgtttatggtattgcctaataatccttttaatttctgtaaggcagtgtttctctttcattcatcactttattcacagttttcacaatttgcgtctttttttttgggtcagtctagcactaaagggttgtcaattttgtgggtcttttcaaagaacaaccagcttctggttttattgatttttccccctttattgtttttctgttttctgtttcattgccttttttttttttaaccctaatgtttttattttcttccttacacttgctttggatttaatctactcttcttacagtttcttaaggtcaaatcataaataattgatttgtaatctctcttcttttctagtataggcattagtattctatatacgtttccatattttgtattttcattttcttttagctcaaaatatttaaaaacttttattgtaatttcttcctcgactcattgctgatttagaggaaattgagaaagaaatttcaaaaatttagaaaataatttgatttcccaaattttcttccgttgatttcttcatgaatttcattatggtcagatagtagtctattttatatgagttcagtctttttattttatatgagttcagtcttttaagattaattctgtctcctagcatgtggtgtcccggagaaagttccacgtgtacgtgaaaagattgtgtattcttttgttgcatggaatgttctatagatagtaggttaagttggttaataatgttcaaattttctatatccttggtaattttctatctagttgttctttcctttagtgagaatagggtgttgagctctccaactatattattgaactgcccatttttcctttgatttctgtcaggttttgcttcatttgttctggggctctgtttttaggtacctgtatgtttctaattgtaacttcctgatgactctttctcataaaacctgccactgtatctctagttacctttttatacttaaaatcttttttgtctgatagagctgctccagctctcttatggttactgtctactgtaaccttttcttttcaatctatttgtatctttgaatgtaaaatgtgcttttataaacagcatatagtgtaacctttgctttattcagtctaacagcctttgccttttgattggtgtgtttattcacattgaatgtcattaatgatatggttgggcttatgtctgacattttagtgtttttttttttttaaattatcttatgtcatctttgttcctttgtcctttgtattaagtagatattttctggtgtgtcattttgattccttggttgataattttaaactgtattttggggattttaaaggtaattattttagggattgcaacgtgcattttgtcaaaatctactttgtggtaatattaacttaattatgaaaagtacatacattttactctaagtatatctccattctctctcccatcctttctgctattattgtcatttatagttcatttctattatatctaacacagggttatacttattgctttatacaatcttatgtctgttaaaaaggttaaaggaaaaagagaaaacattatttatagagtcttttttattaacctgcatatttactatttctggtattcttcatttttcctgagggttcaagttaccatctggagtcatttccttgttccagtatagttctgttctcttccttgtcctttgtccttcaaatattttattttttgaaaatatttttttctattatgtaatatttcttccttttcatttttttctttatgtattatgtttattcattcttatttcgtagacttcatttctgaaatgatgtatttttgtatttctcattctttcaagttctgtcccctcacttgtgagttgtctgattctaatttgtgttgttcatttatgactagtatcttactttaaatactttgactgttttgaaataagttatcagtttaatttgttctatttctatatctttctggcatacttttttattgtctgtaggaatgttattcttcactttatccttttcttatttttaatattaacttattaatgggatttgatgttagtaatttgttttcttattttcaggtgaaactgttttgcttgaacattcagaagaaggcagagttcataagttctccagtttcacagaactctcatgtctatgtatatgtgtttaaaaaataatggcagctagctttctggatttcctggctctcccactttactttttctgcttttttctgtaccttattttcccattgttctcctgtaccaatcatgcacacttttcagtccgctcccagtgatttctcttcagtatgacgctttgtctggaagggagcccgggaaggacaattttgagagttcacaataggttaaagtatagtgctagacctttcagtgcctgacgatgaattcattgtattcacttactcttgaagtggccagaacacctcatagctggttgctgttctcagattggtctactaagctttccaatgttgtctgttttatgtgttctgtcctgccagatgtcctattgtttctttctcatatcctgcagaggtgccaatatcagtcatatcttaatggctgttggtagttttctctaccattttgtatcttgggttttacctagctttgttgtgaatgttgtccatgggatttggggttcattacctagttgttctctgttttcacatggaggattcatggagatttttccaaagctttgccatcactgctgacattgtcttcttagatattattacagcttcactgtggtgaagggaagcttccttccaaggttaagttcagatgtcagaactcatgacagcagtcctgtggtatgattaaagaaagatttattactcacacaagtgggcagttctgagagaggagcagaagatgactatctgtgaggaggtccagaaacaaaaactaaatgagggcatgcaggtgttttataaaggataagtccagttggtgcagagtttaaaagaaccacttgcagagttcaaagaatctcaaagagctagcaagaggtgcctgggaggtattggcagtggtgagctttatcagtaagttgcagaatgtgacagacataggcaggagatgatgctcagagattgcaagcactatatgaaaacttcagtgaggttggggggagtctctgtttcttttctgtggtccccagtttggtgatccattttttagtttctgttatcgttgtgacctactattgaggaactgggcttggatcttacctgccagcttggttcttagcagccatgatcaactcctccttgaagtaacttgtgtttccagatggggatcaggaggtaggcttacttggtaatctcagccagagagaagaaaggggaatactctgtgtggttatccctactttcaggaacaagtcatagttggctggacaaatcattatatcacccttgcatgatagtgttcttagttctgccttttgttcagctctgttaattacatattttcttaaaaacatttaattttatcaagcatccccagagtgtttagtaagtctgcctaatttgtacaccttaccattgtgtgggatccttggtatataaataagctagagttttactctcaaaaaggtcatctgttatagagttgctggataggtgaacagttataaaacagttcactaactgttatgagaacgtagagaaagaaaactaacttggcttgtggcgggaggaaattaagaatggctatgaaaagaaagtgacatttatatttagtgttaaggccgggctcggtggctcacgcctgtaatcccagcattttaggaggccaaggtgggcagatcacctgaggtcaggagtttgagaccagcctggtcaacatggtgaaaccccatctctactaaaaatacaaaattagccaggcatggtggtgcatgcctataatcccagctacttgggaggctgaggcaggagaattgcttgaaccctggaggcggaggttgcagtgagccaggatcacaccactgcactccatcctgggtgacaagatcaagactttgtctcaaaaaaaaaattaatattagtatagtatttactgattctaataagccattgattttaagaacttactgattttaaaaactaccacatgaaatattcacattgtaaatgttacccttatatcagaaatgttaaaatattgaaaatatgtgtcttaaaattgaggaatcattaacgaaagtgttaagtagcaagcgtagtgctgaatggcttttgcgtatgttatttaatcttcacattaacgcagtgaggatagattattaccttccgttgacagatgaagaaataaagcttgcagaaatggtgtcagtaataagtgtcaaggggggatttaagctcacctctgagttctaagtttatgcattcaattaatatataaaatgaatatagcttttagggattttgccttttccatatgtttattttcctatgtttagttcagtagagtgaatttcaacttttcacttaatgatatacaaaactttttgaagccttttttttccttgagtttttcaaagcagttctttaagatggtgaaatgccaagtaacttagttttaactactctttatttttcatttgtgttacttgtcttttttggcagctttctcagttctctctctgtttccaccatgaattttggaagactttagtgtgaaatatacaggcctgtttaaaattgaacataaactgtgccatcaccctgtaaataatatagtctctttagtaaatttaataaaactgtccatttaaaaagtggaagaaagcacttcaggagaaggtattgtgacagttctctttgggaaattagaaggaatagtgagctttttacttagggaagagaggattaaggaaaatgagaaaactggtgatatgggttggcagtgcaggtattttgtctgaatttataatgctttagactaagatcattccatgtgcaatcacagacggtaatcctgcttacacgtaaaaatgaccttaattgcttttaatttaatatgctggtagtctgttagatagtagaaatcatcagttaacctcaaggacctgaaaattgaatcatcttccttaaaatatatgatacttttaatttctcttcagtagcttatgctttcccttcccttttcccttcatttttctttcccttcctccctctctgcccatctctgcctcctgggtgggctattgggaaacttggatttatgaaaatatcaaaacatgtattttcttgaatattattttgactcaaaacgtgatttgttcattattccagagcatttgcttattcttttttttttcttttttttttttttgagatgagtctcgctctgtcgcccaggctggagtgcagtggcgcgatctcggctcactgcaacctccgcctcctggattcaagcagttctctgcctcagccttccgagtgtctgggattacaggcgcccaccaccacgcctggctaatttttttgtatttttagtagagatggggttttaccatcttggccaggctggtcttgaactcctgaccttgtgatccacccacctcggcctcccaaagtgctgggattacagacgtgagccactgcgcccggccctcagcatttgcttattctataactctctctaatactctacaaagttctgtgccttaagtactaactaggctgtctacttttccttttaaaaagtatgtattgcttgtgaaaattttggatctgctttgtctcatgaacatattctaccactaacaggacttctttttggctgcctgaatatagtgaaaagtcagctaagatgatcacttgctggagctagactggggtttgcggggagagtgctacctgcatgccattttggcctcatgtttatgtttcattctcagttatcaaaaccataagaagtgatggacaaaacaggctcaggttctttgttcttccacatcaagaaggaaaaaacctattgctgatataaatctacttcagtgccaactgtaacccctgtgatttttctcattgcttacctttctctgtctgatgacatgaattgtgtgaaagggtggaagctgtgagtccagagatggtagttgaagagtaggatttgacagcagtgcaaacaatgaaaaagcagtgctctctctctgccgggtatcttgtactgaacttgaggctgctgccaagttagggactattcccaaatgcttgtttggggcttttggacaccttaaaaatatatatgaattcattatgtgaattattttttataggtgtatttgacctattggtatgtattactcaagatttgtatgtgttaatgtgaactaagatcattttaatgggagaggtgacgttatgatagaagaagaaaatttagaaataagtttaaatttttctctttatgttaataggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatggtaagtgatccttgatttttaaattgcaagttggaacagctttgtagcactctaatgtctggctttagtgaggatcaggaggagggagggcatatccaaagatagttggcgggaataaaaaagagttaaaatcctacttgggaggctgaggcaagagaatcacttgaactcgggaggccgaggttgcagtgagctgagattgcgccactgcactccagcctgggagacagagaaagactgtgtctcaaaaaaaaaaaaaaaaaaagttaaaatcccagcactttgggagactgaagcaggcagatcatatgaggtcaggagtttgagaccagcctggccaacctggtgaaaccctgtctctactaaaaaatacaaaaattaatggggtgtggtagtgtgcacctgtagtcccagccgcttgggaggctgaggcaggagtgtcacttgaacccggaaggtggagattgcagtgagccgagattgtgccactgcactccagcctgggcaacagagcgagactttgctcaaaaaaaagggaaaatgtaaaagtataattcaggttaggcaatagcctagaccattttgtagcctgtcactacagaccacctcagcctttttgagtcagcgcttttagaggtggagaagagagagataatttaaaaattgagatagcttatatgctaggcttatacacaaatgagtttttttgttcatattatttctttcagtatgtagttgaatgtgttgatgtgagtgtgtttaaaaaacaaactcttgggccaggcgcggtggctcatgcctgtaatcccacactttgggaggccaaggcaggtggatcacttgaggtcaggagtttgagaccagcctggccaacatggtgaaaccccgtctctactaaaataacaaaaatattagccaggcgtggtggcgtgtgcttataatcccagctacttgggaggctgaggctggagaatcgcttgaacccgggaggcagaggttgcagtgagccaagatcacgccattgcactttcagcctgggcaacaagaaagaaattatgtctcaaaaaaaaaaaaaaacaaaaaacacacacacacacaaaaacgcctcttctttttaaatgaaaactctgttaatctagaatatatttgaatttaagtacctcagcttgctaaataaaatacctacttaaacttttctgtgtacccctcccaccttgttttccttagttttggttctgtgtttggtcagcctttacaatgactcgggctatgactgctgagaacttgtaagagaggactggaattaggtttaaaaggaatacgagaatgttaagggtttggcacttttgtgtaaataaatgtctggcatctgtctgagtgtatttcagattttattacatagccaaaaatgaagagattttgcaacatatgttgctttatattagctctccatttagggggagataatcaaatattgaaagtgttatgttggaatctgatgatcatgagcccataaaaatgtttttaagtgtatgtgttactcttctgtacaaaagaaaatgttcagtcacttgtatgaatttttttattcttcatagccctcaaaagagaattttccctgttttttgtttgttttttgagatagagtcttgctctgttgtgcgtttatgtgatcacggctccctgcagcctcgaacttccaggctcaagtgatctttccacctcagcctccctagtagctgggactacaggcatatgccaccacacctggctaattttagtattttttatagaggtagggtctcaccatgttggtgacccaggctggtctcaaactcctgggctcaagtgatccacgcacctaggcctcccaaagtgctgggattatagtcacgagccaccgtgcctggcctcttgtttttctttttaaatggcattgttggtcctttatgttttactaatttgagaatttgcagttatctttcatgttggttacttttatctttcatgttccattggtctccatcttatgttgatttttttctatgagtattgtttggacatatccctttccataatttccaaagtttgctaattagttttctctgattttcattttccccttttttctgcttatcccttctatgttaatcttcccaaggcatgacttttcaacataattacttttcttggctttcagtgtccttcactttaatctattcccattctttgtattcattcagctttagttcctattagtcagtagaaaccttaacctccagttatactgttcaccttaatatcttacccagtttatagcccccaaagttttattcagatagctttaccatacttgaaatgtcctcttatctatccttcctatccttgaaggctcccgtgctgtatactccacaaagctcttcttcaattctttaaacctcagcggtttttttcccatttgactctgtacttattgtctataatgtgcaaaatagcacttagttttattggttttgtttgtttgtttgtttgtttttagttttgctttttgttaattttgtttaactgactaaattgtaacctcttttagggcagggatctcctgctttacttcttgtgtattcctctttggttacaaaatactaagtaaattcacactgattaattcctgtctttgcagatggtttgatagtcaagcacctgcatgacatttggtaataattttggcttatcacagttgttcatgttatggttgttaacctttgtgtacttagtaatcattgatattaatcaatgtgatttatatttgacagccacaaatccatgtggaattgacaatgggggttgttcccatttgtgtttgatgtctccagtcaagcctttttatcagtgtgcttgccccactggggtcaaactcctggagaatggaaaaacctgcaaagatggtaagaagatattatccaaaatgaaaaattttataactattggaattcttcatgatttgttttctctataatcagctctctaggttatactgctttgggagaccagtcacttaatttcacagtcttcacacatggttatagaataggagtgttttgttctgtggcatcacttgaatgctattttataaattattttagtgttttaaataacatatttttgaaaaaagttacgtgttgtatcttttctgtcaaatctcatagtcattgatatcacagttgataactatggaaatgagtagtcgcataaggaatatatttttaacaggtagcatttgtgaataaagaacctctgtgaaagaaagtatgtttattaaacttttagctacaaagaatatcatgagatatattttataacaaattatttaaggatgttttaaattgctttttaacaacagagagatgctttcagagctgggaaaaaaaatccatatttaaaacaacttctttttatacttaagaaacacactttgcctgttctccttactcttaattccctatagagagagggcacgttggagaaagtatactgatttaggacattttaagggacttccagtttggaagaacaccagttcttctgtttttcttcttaatgagaatgttattcttcattctcacccctatggatcaccatctggttctctagcaaccagcaagacctggtaagaaaattgttgtatttagctgtggcttctttatctaactctgaaaagcagaagcctgtgttttggagtgtgttagagtccctggcaagggggccagggagtcagagagatggaattgagtctgtgtacaggatgtttgttatgacttggcattgataaattatcctcatagtaaaaggtgaagctggctgactcttggtcaaatggtttccatggcagacagcaatttggtttcaatttaaaacaaaaggtttttgtaatgttgcttttttctttaaaaatgtagcctgactttaaaacagaggatttattttagcaataatggtctatctgctccctcacagcagtgcaagtgtacatatttaaccagttttgaatttcatgtgtgcatttggcatgtagtagccttaagttaactgttctgttttgatcaccttgctcaaattaacagctctatgacttctttgtgaagttctaggctggctccttttggttgttagccggggcagtgaattgtacaaagttattcctacttggttcctgcagtggcatttgggctgtattttcttcaagttggaattcatttataattagctctagagtgaaagggctgatattgagaggcttcactcctcttctcagttttttgacttgtaattgcagattgattcttgaagtttatatgccagtattttgttttggactcatttatttagctgggaatcttttcttattctttcagttgtcaatttgcttactgtcttttattagcttcctatagttagacgattttttgctggtggtttacttgaacaatttaaaatgaaaaaaagattgagctcagtatcttcattcttggttatgtggttaagtatttggggcttgggctttaaacagttcataaataaacctaatttaaaattcagtgaaataaaaatctgaaaatctttattttttaatactgttgttaagtattagttaatatttcttgagtacttaaatgttcagtactttcctgagttttagatttatctcctttaatccttacaacaaccttacaaggtatagatggggaaactaggcttagcgagattagatattttcccaaagtttgtgtagcttcttgaatcaaattatattggatccacaactcttaaccactgtgttatgtttatctggttccttccctccattgcagctgtttgtttctccatagcttgctttgtcctcaattctgtgaggtattgccctgtatttctctttgttaagacagttttactgagatgtaacttacatagcatataaaatccatccattttttaaattgtacaattcggtgactttttagtaaatttacagagttacgcagttatcaccacaatccaattttagaacattcctatcaagcacaaagattcttgtcctaaatttctttatctttttttaaaaaatgcttcttgaacaaaggatctatatcctacatttccttctcctttaatactgagctacttagcttcttagtcattacatagtcattattcattgtacttttaaatagctggattaattccaatgaaaccatagaatgtatcacaacttaatttggagagttagccattaaacagcttgacctcagagtagactcttctatttcactgtattactttccatttccactctaaagagagtgcacatccttttgtgttaatttatgtatattttatatttatttttcagttcttgattctttatctagagcaggtaaattttacctctgggtttcaaagtattcttcatttcactttgttgttctaggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtaagaagctctactgatagtaaattctgtgtggtgtttctgtttttcacaggttcctgaaaacattgactaagataacatgacatatatattggtttccagtaaacagctctttaatggctgtctattttaggatatggtgattagaatacaatctcaagtttaaaaattgctagttttttgccttggatgtcttagatattttttctttctaaattaagtccatgtttgctgactttgggtgttgtctgcagattttgctcggattgcatcattaccatgaaaaatgtgggaagaaattgttttcagaactctttcccttcccctagaagctttaattccattttcagtactttatagtaagaatatagcttacttttttttccctaaatacatgaatgacttgatttccaaaactttgccagcccatgcagctttacttctagtttgttgttgttgtttgttttgttttgccatgccaccctgatcatagtccagggaagtacaactttttacatactcaacaattttgttactttgagatttattctgaggacaagcatagtgacaaattacacctcagtatataccaatgccttagagccatctaaacatccaggagccgtaagaatcacttagcactgcaggaagaaatagttattttgagaattcagtttgccatctgactaatactgctgggataagccttttgtgtcagagagatgacaagccatcaaggaaaagagagagaaagttcatggaaaagggcacacaaaatatttaaaaaaaaaaaaaaaaaaaagaagtaaaactgtaatctcattattgggaggcattttcaggattggctctagaacacactgatctgaaaatttcccacaatcttatatattgctgggataaatgtcttaaacacctcttcatatgtttttttttttttccccttccttggcattaactgatgataccagtgtaataggagggatggatctcacctttagaatatctgaaagttacattttattatctatttttagctcattttttgtatacttctctaggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggtttgttttttgctttttcattttcaagccacttttataatgggttttgagtcgacagtataatgatttgagtacagatattcttttttcttaacagttgtctggggtgccaaaggtaccttttacagaaattttactcaaccttcatgattctagggataatatattctcttccacataatcctaggatggagagatgtattggtatgagaaatggctgctgatcagtttctagtcttaaaagcttatgtaagtgattttcctcattttgggtaaagccactttctgaatttcctaggggcaatttctgcaaaccaaaattatgtaagatctatactggaagaactggctgtcctaagttaggaaaacaaagcccacatgtatgtgtatatctatatctatatctatatctatatctatatctatatctatatctatatcttttattgctgttaactggtgttggggcagatggtagaatatattaaatattatgatggttacatgcaaacaattttaaaattgatttatgggctgtgtgggaacaagactaattaaccaaagcttgggaaaaaatatttaccaagtggtagagttaagtttgtggcaatcaaatagattatggtgaaaataatcagtgattaatattttatcacagtgttttattagtggcctatatccctgatattggtgttaagtctaaaattaacaactttgaattagactttgctacaggtcttatggatcacatagatagaacagagttaggtctcaattttcctttgggggaaacttcacatacaaggatggctttaaatggctcttcagagagacactgtacacatctaatggacagaaaattcagactctagaacagttgttttggaaaggtattctgtagagtgcccatgaccctgagggaataatgacttcaaggccttgcttccaaaatggaaacttggaatagaagaaaccccgttagtattccaccaggctcaaatactgaaaacggcatctgttgttcttgcagctggttttcattaatagaaaattttgcatagactccataaattttctccctgttagtatttcactgcctcccactcttttcaaatccaagttgatgtttgaatcttttaacagttggagtgcattgctgatgagacaaaggttatgagtttatgtttcagacaggcttttagcttcattttggtcagcttgaatatagattgcctacctaatcccatctagttcacacctgtggattatgaactatacatgagtgtataggtacgagtatgcttaggaaaacagtttaaagcccataagttttagaagaatatctgtagcaagaaaatttacgtaagggaatgcaccaaatttattatcatgtagggtttttaaaattccgtatttggttttgcccatcttagtctgctataactgactgattagcctgaaaataaaatcatttgtttcttactgggaatatttcaagtcttattttcctcactttaggtataatactttagatacagaaatttattcagaataacaaatagttcagaagggattcagataaagacattacaatttatggaggttctgagtgaccatctttaagaataaaaattaatacactttatataacaatatataacattgattaaataggatttattttcctagtttgcagtgagtgcagtagattttaaaattagaattccttttctggcctctttgttatgttttcttgagctatgcatatatatatatatacatacagacacatacatacagtggtgtcattggctccgtcaccccttctttccttcttccctgtatggtaccagcatccttaaacctgtttttaatttttttcattcattcgttcattcgttcatttgttccttcattcattcgttcttttaatctgcaaaggctctgtcacccataaatcttatttttagatccatctttctccttctaggtttgctggaacacaactgctgtttgttttttgtcccctttttatagattgatgtttgtggtaaatttacttctgtatacatgaagacctccctttataatttcccctggagattctgatgtcctaattcactattaggacatcagagcctttgtcattttatttacataggcacgtctaggaaatacagcatatagttatttattctcttcttatgttgatgtaaaatctgatacttggcaaactaaagaaagagtgcagctcttcgtctaaattagtcctgcataactcggggagaaaatctggggttttccatcctgagactagtagtgattctaggagcaactgctactaccagcttttcatctcccttgatttgataatactgtgaacttgaaaacttttacaaagatgtataattttaaaaatccctctttttccaagaagtgtatttgctagccttttgttagtggcaactgattccagatactgatctaaccccagtctgggtgacattctcccttctagtcccattttccttagaaagctccctagcttttgtcatgcccgagaatgaaagctgcttttcgctgggactataacagagtatcagattatggttgtgataaccctgttctcttctgaaagacttaagagtctgtttggttggccgggcgcggtggctcacacctgtaatcccagtactttgggaggccgaggtgggtggatcatgaggtcaggagttcgagaccagcctggccaacatggtgaaaccctgtctgtagtaaaaatacaaaaattagctgggcgtggtggcgggcacctgtaatcctagctactcgggaggctgaggcaggagaatcacttgaacccggcaggcagacgttgcagtgagccgagatgatgccattgcattccagcctgggggacaagaacaagactctgtctaaaaaaaaaaaaaaaaaaaaaagtttgggctcacactgttgtatatgtgtttatagtacatttggaaagaaaagataattatttggtaaattatttatatagcaaggtaagacatagtaaacctatgtgtcttgagtggatcacatgggaaagtctcactgtgttcattcatttatgctacctgctcgcttagtggaaattctttagatcagcttctcacttcctcttttgtaagtggtgatgtgaccagatgctggctacattagggaaaccagggagaaggaatggggaattctgggtattagatgtgtttttatattgtacagagttgtagaaagaatgaatagatttaacctcaggtttataataagcttcgggaaggagggattgagcgtagggcattgctaatgatgtcacattttttaaaagatggttgtggtatttggctcctgctttaatagaataacatatatgtgagggtatgtctgttttccctacttgtcaggtgatagtggccacctatctgtaggtgttaaaatttaaaaggtgcctgctagtacttgtttatgtctcttcttcattatgctgaaatgacttcattgccttttgtggacaaacctagtttacttgtctgcacagtacttctgccaccaccccccctcctgatttttactatattgttgtggggccttcccataataagtactaaagcattagcagaaagaataattttcatgtttttgatagaggaaagatcaaaagcctttatttctattttatatgaccctgcagtaggcagaacaaccttgtttcttaacagcattcctttttttttttttaggatcaggttttactgctgaaaacgtttgttgcactgagggcctgtagtacttcttactaatagccaagatatatcgttgataatttataggtttaaagcatttttgccatggtgtaaaattaagaatgtactattagcttaaattttcttgaggttgcttttcttgttatatacccatttaactgattgacaaaatcagtgtgtttctaatagttggttttattgaaaacaatagtattgtcaatgctaaatttctctcacagtttcttttttctttttctatttatttatttattttattttattttattttattttattttattttttatttgagacggagtctcgctctgtcgtccaggctggagtgcagtggcgcgatctcggctcactgcatgcaagctccacctcctgggttcacgcaattttcctgcctcagcctcctgagtagctgggactacaggcgtctgctaccacgcttggctaattttttgtatttttagtagagacggggtttcactgtgttagccaggctggtctcgatctcctgacctggagctgcgtgcctcagcttcccaaagccctgggattacaggcatgagctactgtgcccggccttttttatttttattttttgagacagggtctcactctgtcgcccaggctggagtgcagtggcgtgatctcggctcacagcaacctctgcctcccaagctcaagtgatacccctgccccagcctcccgagtagctgggattacaggcgcatgccaccacgcctagctaagttttgtatttttagtagagatgggatttctccatgttggccaggctggcctcgaactcctgacctcaaatgatccacccacctcggcctgccaaagtgttgggattataggtttgagccaccatgcccgacctgttttttcattatatactttttattttggtttctcctgcccactttcatttctgagtttctactgacaatgcagcaacacctgatagtatagataaaaagagagattttcatgtctactgtaagaacatgtgtatttgctttaaatcttagagtaagcttccctactttaagaggatacaatgtccatagctagttttgtacaaatctaattttacctggcacacctttgttgggaaacagaaacaaggtttattagaacctttagtaccaagaacttttgaataaagaaggtattattttgtatgatgtgtactgaaaacttggcatttgctgaatgttctgtttcatattctaagcctgaaattgcagggctacattttcctatgataacttcctttatttcatcaataccctaataaggaaatttgtttcccaagtattcaaacttcttttttaaaggagtttctttgtctggtatcttagcctttgtactgttaaaaacatataggaacctgttgataattttttttactgttggtttgtaagattaattcctcattaagaaattataataaatctattgttgagataaggctgttctgataatatgacaagtatcaacaagtacttccttttgaatctttgccaatttgtaacattgtgtttcttaaaattgattataccttcagtttgaggctgggcacggtggctcacgcctgtaatccagcactttgagagtctgaggtgtgctgatcactggaggccaggagttcgagaccagcctggccaacatggtgaaaccccgtctctactaaaaatacaaaaattagccaaacgtggtggcatgcgcctgtaatcccagctatttaggaggctgaggcaggaaaattgcttgaacccgggtggcggaggttgcagtgagccgagatcaggccactgcactccagcatggacaacagagcaagactctgcttaaaaaaaaaaaagaaagattgattatacttcagtttgagaaatattcaaaataactaatttaaatacctaaatatttgcccatttgtgctactttaccacacaacatgtactgtatgttagtatggatatatatttctccccaaatcttcataacatatgatcagagaagaatgatattgataaactccatcattagattcctcaactcagcagagcacctggagtttggacttaatgttcattgagttgtaaacctggtgctggcctgttgtgttattttgtgtctggggtacatcgcataacaatgaaatttgtgaattcctatttgaaaattgctagttgattattgggcacagtggctcacacttgtaatcctatcactttggaagggttgaggtgggaggatccctggatcccttgaggctaggagtttgaaaccagcctgggtaatatagtgagatccccggctctacagaaaataaaaattagctgggcgtggtagtgcactcctggagtcccagctacttgggaggctgaagtgggaagatcacttgagcccaggagtttgagacaagcctgggcaacatggcaaaaccccatctctataaaaaatgcaaaaattagctaggcattgtggtgtgcaactgtagtcccagctaccctggaggctgaggtgggaggatcacctgagtctgggaggcagaggttgcagcgagctgagatcatgccactgaactctagcttgggcaacagagcaagaccctgtccccccaaaaacaaaagaatttattttagctgtgcttaaaaagaatgagagcagagagggcagttttcccttgttgacatgttaatcttttccctattaggtttttggggcctcaggacagtgaggctttcagaagtgtcttatgaagcagttgagtataattgaccaggatgttgacattcgtcatcatgatgccttcatctggaactctgttctcaattttttcgtttcctggagtaattcaggttttagaaagctttggtcacagtagcaatttttagctctaacagaaaaagagcatagtaattgcaaatctttaatattcaatgcctgattccttgcaaaaaatattataaaactacccagagtaactatgatacttcaattcttttcatatttaaaatcacttatatgtactcagacttaatgtatcttgaagtaggttaaaaggctttgaatatagcactgtaattgcccctacctctctctcaaacaggtgtgtggtgtccctttacttcacctactgggtccaaagcatttctttatacttgtcatctcagtgagatttggcatgattgaaatgttatttccgtggataaatattctgtgttttaaaatcccatttgtgtgaaattatattttatgttctatgaagttgtatcagaaaaaatatgctccccaaccctcagtcatatctgtcttccttatgtataagcttttaattcactgcttgttttggatattgtctggaacattagaagaggagtggttcattttgggcataatttgagtttctcttctagaactttatagcattccaactctagcacattttatggtggttgcttggttgtcctcctgcatctgttccttgaacttgtcttgtcaagtgaagttgcatagcagcaattttggtagtagactggctgcattccaagattgcatgggcagtcctgtcttgacatttaatgagctgatgaaatgactcaaaaactggatgtgatgtctgtagaagatttgccattacttcttctttgtgcagataatgttatggttaacccacgtctatttcctcttgtagcctatattctcagtgtggtttagaatatttcagaatgttaaaccaatgtgccacagtgtggtcaaagcagctgaaaccactggagactctggttcagatttggagttagattttagaagtgacagaagcctaatttcagtttaactaattaaaccactctgaggtaatacagtgaagtacacccttaagagttgtcagatttaattaacattggcacagtttttaaagcataagtgtaatcttttggaattgcctaaagtggttcatttgttctgggttcagaatatacaaacaagcttttgccaggatttgtgttattttaaacataaggagcttaaactgtatttatagacctagtaacctgtccaaaacttttacaggaatatgagaaatggaatagtgatttctttaagacagagcaacatgttcttatttcactatggttaacttgtgcccggtagaaaaagattgtgtggctggtacaagagaaatacttagtggagaagtcagttttctaatagtgtcacctctacaaaagtaatggaaggaaacatttcagaaattggactttgtgtgaaggaaaatacattatctgtgtgtttagatgcaaagtctcacagtcagatattgtttaagctggtgatcccttaatctcttcggaggatccttataattcctttctataccatactaacaaaaatgataatagcgttatttatttatttatttatttatttatttattttatttttttttgagactgagtttcactctgtcgcccaggctggagtgcagtggcacagtctcggtgcactgcaagctccacctcccgggttcacgccatcctcctgcctcaacctcctgagtagctgggactacgggcacccgccaccacgcctggctagttttttgtgtgtgtgtttttagtagagatggagtttcaccatgttagccaggatggtcttgatctcctgacctggtgatccgccctccttggcctcccaaagtgctgggattacaggcgtgagccaccgcgctcggccaataatagcatttattaataacagcagttatcatcatcattattatttgtgtgtccttggacttgcttcttagctttttctcttcattttttaaaaattatggaaaatgtcagagtatagaaagcagagtagagacgaccatgaactacctagttttaaccattgttagtacatggctgatctagactgcagcgtgtcttaagcgggagggctaaggagatggcagaaatgggttttctaataatatatctatggtcttaatacttcctttttgacatagcctaaaataaatgaaagaatcaggtctttgttgctccttctaactaacctcttagctagtgttttatatgtaaacttgcaaatgtgacaagaagaaaaaaagtagtttttttcatctaagacgtgtgtgtgtgtgtgtgtgtgtgtgtgtgtgtgtgtgtgaagtaattttaacttcatattagaattaaatagtatatagcttggaagaaagaaagaccaaataaaagacatttgtttgaagctttagtgagcctgatcgatctgagctaagcctgaaggtgacaggtatagaggggacagtgatgtaaactaaaaaaggaaccaattaattttattataggctgtatgtagtcaccactctgaagactctaatccagcacagtgcaatatgtagccactaattacatgtggctctgcagaacttaaaatgtgcctaggttgaattaggatgtactttaattgtaaaacacattctaagagacctagtattaaaaaaaaaaccataaatgtcattaataaaattttaatattgattacaggttgagagaaaagaattttggatgtgttagattaaataaagtatactattaaaattctgtctactgttttatactgtttttgagatgagtctcattctttcacccagactgaagtgcagtggtgcggtgtcagctcactgcaacctctgcctctcaggttcaagcaattctgcctcagcctaccgactagctgggattacaggtgtgcatctccacacctggctcatttttgtattttcagtagagagggggcttcaccatgttggccaggctggtcttgaactcctggcctcaagtgatccacccgccttggactcccaaagtgctaggattacaggtgtgagcgaaaacattctcctggcatgttttgtactttttaatatgactactagaaaattttaaatggacacatacggcctacattggtggcttgtgttatatttctcctggacagtgctgttttagatccaaacctattgtaaaaactacaccagatgagaacaaggagatcaggaattaaaggaaacagtgtgcttacaaaacgtggttttaaaaaaatctttaataaatcttaattacattgcttaacttgaaatagacatgaattgatagatcttgcttttgtatttacgtcattaccaaaaaaagaccttttagtttttgcttttcgagtgagagaacaaggaatggttggaagggactagtgctcaagtgagtaaagcaaccaaatcattagttgtgccttctcaggaactattttgagttcttcgccactgtgccattcttaataccttcattgttaatacctttgttgagcttgttaatactttgatcgtggtcttcatttgttgtcctttcagcaaatgttgctgaagacctttttcttttcattgtttgctttgctctcttcttcctgagacccttgcttgtatctagagcagtattaacactgatccaaaccccagttttctcaagggactgaagtgaagatgagcaaagtatttctgatctataatcctttatctgcaattctgaaatccaaagggctctgaaaaccaaatgctgcttttgttaattgatttggtggaaaacttgatctgaaccagtgtgagactatttgtagtctgtcccacactgcgggcatacttttatttattattattattattattattatcattttgaggcagagtttgctcttgttgcccaggctggagtgcaatggtgtgatcttggctcactgcaacctctgcctcccgggtttaagcaactttcctgcctcaccctcccaagtagctgggattacaggcgttagccaccactcccggctaatttttctatttttagtagagacagggtttcaccatgtttgtcaggctagtctcgaactcctgacctcaaatggtcctcctgccttggcctcccaaagtgctgggattacaggtgtgaaccactgcgcctggccgtgttttattgcagaaatattaacatgtttggctataaatagtgctgccctgaacccaagtagaggtgatatgctatgtgcattgtgttaacctttctttaaaaaaaaacaaaaagacaaaaacagtctgaattcaggaatacaactgaccctgactttagataagggattttggacctctcttgccatctcacagaaattgaaaatattttgctaaccataattctatattggtttatttatttttttcataattctacatttaaaataagatatttatctttaacacaagctgaacagggtgacagagataaatgaagtgtttctgaaacatgggtttattgtgtcaccctgcttaaagtgctttcagaaccttcttgctttctgtaattctccttatcctggaatttaatacctgccatagggtggtatctgcttgatgctgtatcctttgagtcccccatgtgttcgttctatctcagtcaaggcatttctttcaaagtcaaacatgtcgtgtgcatccttggctttgctgtgtcttaactcatttctttttttctagaaaatctgtttctctttttctttgtcaaaattctaattcttcaagatgaatttcaactgctattatttcctgaagtttttcctgattacttacagagaggggatatgtgtgtaattttaatgtaaatatcgtttacctccccaattagattgtaatacattagctggaagaggccctgttctaaacttctcagcattcatcaggtctatcatggtggtttgcatttactagatgtctttactaatgttgtttgatttgcggggaggtgagttaggggtctggcagagcagcaaaagtgtactcatatgaaattgtcaaatatttgttcttttttgtttactgttttagttactttatatctaactagcaaaagtaaacaataaaaatgggagtaggaaatgggaggctgtagctgtgtagtttcccactggtttcaggatacataaaggtctcttggtttttgtcttcagtttaacagtgagtggttgttttggtcttttattttcatatattcttttatatttatgtatttttattttgaagcactacattaaataattaaatacaatcatttagctgtttacatttaggaactaaagcattttaataaaatgatttttaaaggacaggaaccagtgtttaccagatagtgcacctaatactgtgctatatatttagcattattttatttgatccttaactaattcagtgatggcagtggcgctgtccctttttttttttttgagacagagtctcactttgttgccaggttggagtgcagtggcgcgatctcggcacactgcaacctctgcctcctgggttcaagcgattctcctgcctcagcctcccgagtagctgggactacaggtgtgcgccaccacgcccagcaaattttttgtatttttagtagagacggggtttcaccatgttggccaggattgtctccatctcttgacctcgtgacccacccgtctcggcctcccaaaatgctgggattacaggcgtgagccaccgcgcctggactgctgtccctattttatttgtgagacttgcttaaaggtacccactgagtgataaagcttatatttgaaatacaaatctctttctgccacaatactgtttgctgatcatgagaaattttttagagaacagaagaatgaagggaaactggtaaatagaagatgcagaattatgtttactaaaaaggtcttagaattgtggcatttattatttttctcacaatgatttttaatttcattcttacctattttctgtctttttaaagatttttttcctaggctggagttacttaggctggagtacagtggcttgattatagctcactgcagcctcaaactcctgggctcaagcaatctgcctgctttagcctccctagtagctaggactacaggcttaccacaccatgcttgactaattttttggtatttttgtagagacagggccttgccattttgtccaggctggtcttgaaacccaaggcttaagtgctcctcctgccttggccttccaaagtgctgggattataggcatgagccaccatacccagcctcattttcctaattcatacttaatcatccatcttttgtttaagctatttatttatcaaaataaacaaaaatgttggaaagtgatatagctgaaagagaaaagattttgttgatctcataatagaagtagaaatataagtgttattctttaaaagtttaatattgggcatctagtttatgcttttacaccagcaaattttaataggaaagccaacatttgaatgtaaagatcagcaaaattagcgtaatttattaaatgtaagataatgcaaaataagatagaattaaatctaagaataaaaccgaatcaggcatattttaacataccacaaacttataagaaagtaatatttttgtattgtataatacagaatatttatcactctgtgttgggtgctccctaatagaatgattgaactctccctaatgcaggacataggttcactgttaagtatatgaccttttagatgaggtagcagtacatgttcctggaaatgcaattggaaatgctgcagtagaaactgagaagaccttgttctgttctgaaagatgcagcaagccttccagagtcccagtgttcaagtccctacctgagaccatttctgtcacttaaaggggcctgcgtgctgggcaaattagcctttagaaatgttatttcatactaaaaacatgtacatgtgaacaatatctgctcctacccccccaaaaaaggtatcagatataatcttatatgtaaatatcaaatattagttatattatgtcaataaaggtatcccaagtaagtcaacactgaatagtgcatggtgaatgcactgtgaatacagtatgaatgccagagtgaatttaataatgttactattaggtagttggaaagagaaggtacatcctagtttcttgaaacttagatgcagagagggtgtcatataatcccgatacttttgtgattataatctcagaggaatgagagatttattgagatcccttttatctgttttttgttgttactgacaacaacaacaaaataaaaagcatgctaagtggaaaaagtcctgaaaaagacatcaactgtgtttacaagctctgtgaccttacatgaatctcagtttccataggcaaagctctcaagataaaataaaagatgttataaaacaaaatatatgataaaataatgtatatgaaggtacattataatttgaaaacaaatgtgcaaacttaaggtgatgatactgtatttttaattttgccacaattgtttaatagaagagttgcataatctaaagttgccagaatttttagaaggaagagtaatatgagattggggggaaaagtggtcaaatagaggcttatatggaaaatttgaaatcatttttataaaatcatcatgtaattttgagaaagcattgtaataggaataccaagatgactcttggatttttatacaacaggcagttggatttgttatttttagctgaagaataaatgcataattcatccccttctcttttgaatttaaacctgaaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggtgagtaactccaaagctttcttagaaatgggaaccaggaatgaaaaaagatggagatagtcagcagtgtaaattattgatgttttgaggcaattttgaaaccttctttactgcccccccgcctttttttttttttttttttttactgagaagggaccttttaaacgttgacttactactctagctacccagtttgaattgaagggctgaatacacatgcacaggcacaccttcatcaaaagaattcagtctgatagtatgaataatataccttactttaaagcttactgtggtattaaaggaaaatacttcaccatgcttttactccctattaatctgcatattacttgtttgtgatattagaattgaaacttgagattgggagcaagacataatcataggcatttgtgaaccaaacgcttaagtaatttaaaagtgaaaatatgttgaatgtatcaatgtgtgtgtccttctgtgccccttttataattaatcttttaggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaaggttagcaaaagaattggaatattaaagctagggactaaaagggagaacttctagaatttctgaatcttcatgctgtgacccacctccctcattgtttgacaggcagagttcaacaaaaaccctcaagtttttttttttttttttaaacggtgtcttgctctgtcacccaggctggagtgcagtggtgcagtctcggctcactgcaacccctgcctcccaggttcaagcgattctcctgcttcagcctcccgagcagctaggactacaggtgcgtgccacgacgcccagctaatttttgtatttttagtagtgacggggtttcaccatgttggccaggccgctcgaactcttgacctcgtgatccgcccgcttcgtcctcccaaagtgctgggattacaggcgtgagccaccgcgcccagccaaaacccttaagtttttaagtgaagggaaaggcccattcagtattttattagatgctttttaatacagatactttgccagagtgttttaaatctgcaagccatagtcttcctctactttcttccatttgaaaatgatgaatgacattttctgcaattagctgagtaaggaaatgtgtgcttcacgtaaaatggctgttgatttactttaaaaaaaaattcgtgatttactttaaacaaaattttagggcctgactgaggcggaaaaggccaacaatgagttattctttattttcttcttcctagaatagttactgaaaagaataccaggatagccagagaggaagctcccaacctataaatctgaagaataatcttttcttcttccagattgttttgggcttgtttcagataactcatgtaaacttttttgtaatatgcgaaaacatggggtgttggagtcagagttggattctaatggtgttcagttaaatttattaagtgaataaatgaaataaataaattttggtttgcattgggtgatgttctaaatttcctcatcttgaaaatggggggtggctgggtgcggtgactcaggcctgtaaatcccagcactttgggaggctgaggcacatggatcacctgaggtcacgagtttgagaacagcctggccaacatgacaaaaccccgtctctactaaaaatacaaaaattagctggtcatggtggcgcatacctgtaatcccagctactcgggaaactgaggcacgagaatcacttgaacctgggaggcagaagttgcagtgagccgagatcatgccactgcactccagcctgggtgacagagtgagactctgtctcaaaaacataaaataggggtgatgccatacttgcaggactgttgtattaagtgacaaaatctacggacaaaacgtacttaggataatacttgataagatgtatctattattagtttgaattatgatttttaaaagtgttatgggactcagtgctataatggtagtataatggttacattcatttatatggtaggcatgatgacttgccataatcttaagcacctttagaaaattgaccactaattaagatctgtagcattgtggtcacagcttttccacttgattactgataaattttaaaagtaaagtcattctgctgttagtagaataaatttttggtgcattagagttttaaaatttctcccctgaattggcagtaaaacttgaagttgcatttattagagattgacatcaaatttttctgtgcttgcaagttatgtgaattttaataggaaatagtatgcctcttggcacttctggatcctcttgcccctgacaaaaaccaaaccaaaccttctttctggatagggtttagacttatgccatatgacttagttgttaatgttcttttgcagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaagggtaaacagctttacatgtgcattctttgcaactgcagtgtacatttcggggaacatggcatagttacagatgatattcttaatgttttaaataatacgtattaggaatctgagaactaaatgatagatgaacttttaaaaacactaattgatattttgctgatttgaatgaataattattagctaattttactcttgtcgtaattaactttaggtgaagaaagaggggaatgggttaataatcaaatgttactgatgagtatactgatatgttaagtatatataccaagaggtattatccatctgtagttgcttgcactccttcccagttatactagattccaagcctattgaagtaaacccaccgaaacaatgttgtgagctaagaaaaaactacatttaaaaagctttattttggagtatttattaattcaaaatggatagtttggtttgatcattattataaactggcagtagctttgttattacaagatagaataaactgttcacaacatgatgtttttcaagggcgagtgttcctttttacaagagtcagcaaattttttaaagccggcagctaagaaatctgaaatctaaagaaaaattccacttataaaagaagtcaacaggccgggcgtggtggctcacgcttgtaatcccagcaactttgggaggccgaggcgtgggcagatcacaaggtcaggagttcgagaccagcctggccaacatggtgaaaccccgtaactactaaagataaaaaaaaattagccaggcatggtggcatgtgtctgtagtcccagctactctggaggctaaagcaggaaaattgtttgaatctgggaggtggaggttgcagtgagccgagatcgtgccactgcactccaccctgggcaacagagcaagactccatcttggaaaaaaaaaaagaagtaaacagtgtgaacatataaatatgtttactgtatttgctacttaaaataatttccctgaagtgacattgattccatgattagctagtaattcatctagtcagcactgacatattgtggtgatctttgctctaaacattagctgccagacagataaatttaatagttgggactaattggttgctgctggcaagtatgaaatttctctcacagttgtttctctttggctcttgtggtgtgcacatgcctgtcaaatgacaagtgcaaatgcatataaaggcaggacaccttcagttttcagaaaagcatgttcatacattgctaccaagtcagctatcagctgacaggctgatgagtgaatatatgtcctcaggtatttcgtgagagctggcatgtgatgtgcttttttagttccagtattcaagagtctcaaaaactagcacctcactagtttacttgaaagggcatttggccaaggattaggttctagttctagctctgtcatctaactggcttgaagacattagataagttgttcacatttcttgtagtgttttgggctcttcatctataaaaagcctatactgtaggattactgtaagattaaagtgcaaaactcaaaaatggaaaataacagcaaagtaattattctaaaatttcacagagattgttgtagcgtagtgtagtgttcattgcccagtggacacatcaaggggtgagtcgttgttcttaccatatagtatgctcccttggaccatatgaccaaatacattttcaagctttgcttttgacttcagttaaaggcttagtatttataattacctttcatgtacttctgcaacttattttgaggaagagttgattacacaagtcaaaaagtaagttcagcatattaaaaactcaaattagttaatattcaaaagtatataaaaatattttactcagaagtgaaccagattctgagaccagagctttaaacctttgctgttttcttgaatgttaattttacaaatgccagtactgcaataaactgttggtttatttccaattcctaggtttggatggaacaaatgtattggaaagactaaggaaagctgactcacttcctttttgggatatggaaaaaaatatttagtttagggtgccaaaataattgaaagcattgtagccgtgattttgtttaacccatttccttgatttgctgtatgttttctttaaatttatttagttactttgcatgaatatgactctttcccccagataataaaaaattgaaatgttaaatatttattattttgaatttagatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttggtaagctttactactttttactcaaacagtatattctttccatgcaaatatcagtggctgctatttatcattggttagatacttttaatacaacttcatatgaatgtgtccattcttcttctgttctggaattgtatcctgtttgttattaatagtgatccaggtacttggattcatctttttattatgtgaaagtttcattattattggacttgtaatgaaatttataactccctagatactcctgaaatgacttttgtaccagtaaaatatatatatttccatcttttccttctatagttcaagaagaaaaagtgaactgtagacccttatatagagaaaataaaaccacatttaaagtagaccatttgcaagaattttaggaaactgagtgatttgtagcaggaatatgtttgaagcatggggtcagaagatagattgatttcagagaattggtctcgttttagaattgcttttaaatgaatttttctattttaaattgcttacaatgtaatgttttatatgttagggcttttttttttctttttgccagcaagacacttgtattctcacatatttcatcactctgcttctcccctgtctactgcctttctgaaaatagggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtggtaagctgcatttccctccaaagcaagctagaatgagagaaagcagcattttcaaagtactttagtgtgtgttttttctaaagttaaatagtgtggaaatccagagggggttatttgtttggttaaagggtaggggaatgcaagtgtttgttacttattacttgtttgatgatagcaatttgatgttatagaaaaattaagtcttatgctggtccattgtcttatgtccgtaacccagcactttgggaagctgaggtgggaggaatgcttcagctcaggagttcaagaccagcctaggcaatatagcgagaccttgcctctacaaaaaataaaaaaattagccagagtaatggtgtgcatttgtagtcccacctactcaggagggtgaagtaggatgatcacttggccccaggagattgaggctgcagtgagctatggtggcaccactgcattccagcctgggtgacacagagagattctttcttcaaaaaaaaaggaaaaattaagtcttttacccttggacattaaatattaagtgtaaaagttgcatagtttcatgcatcatatttattgtaaaggaagggaagaacattacaaacagtaaaacagtgaatcgcaaaacacaacttacttgtcctttgaagtgcaaagagtaggacagtcataaaaaatttaaatgtttaacaggccatacagaaaacgcgtatgagaacatgtaacccagtataaagtaacagttgatgagaaactaaagagaacatgcaatgaacatagtaggcagttgcagtttaactgaagctgatgttaccagatcttttcatttggtcctgaatctagatttttttgtgtgtgtgactccctcatctcctgatttttaaataccggcaagtacacacataacactaacaacaaagtgtgtaacaaaacattgttggctaggggaaacctggcttataacttaaatatatatgaaggcccatttcttggtggatagacaagaacaaattggtagatacgattaagaaataagtagattaaatcagaaagagtagattatgggaggggtgtagggtttgggtcaatatgatggaaagtaacaaactgctaaggatattagaggtaattaactattgacatgactttcttttgtgcttgagagaatgtgtcagaattcccataggaaaaatttggtctgttctgatgccaacttcagttgtgaaagagaaaggacacaagcatgtagtggaatgattaagaggttatactttggaatctctgccacacattagcttttttgctttacacaagtaataaattctttaagcctttattttttctcatttgtaaaattggaataataatagtaattgctgtatagggttgttatgaagattaaagataatacatggtctgatttctggggagaaccagtagcagggaagtcagttagaccagtgtggtaatgcaggtagacctggacaatggtggtggcagcagcgtgtgtgttgaagagaggttgatggattcgagatgtatgtggaagctagagcaagcagaagttgttaatgagttctgtgtgggaaagaaagggaggaagcaaggatgacctctagattatgtgtcatagatgatggactatcatcggagaagagacatgaggttgaagatacaaattttgggattaccaggatgtatttaaaatgaatgaggttacctaaagagaaggtatagttcaagagccagcagctttctctcataggctttgtgggtgtttaggctgtctcacacctgctgaactctgcccagctctcgccatggcagtgtgagagcagcctcaggcaatacattttaaaaatggaagtggctgaattccagtaaaactttattacagaaacaggcagcaggccagatttaacttgtgggccataacccccatcagtgggctaactctgatggagagaaaagaaggcacttggtaaactatgcaactctggttgaggaagagaagttcacagagaacactgagaagtagcaaccagagaggtaagaggaaaagcgggagagaatagaggcacaaagacagagattaggttgtttcaaaaatgaactctgttgaatgagtaaggggaggtctaaaatagcatacactggatttttgggtaaagtggttattaaccctgaagagagtaatttcagggaagtaatggtgaaatgcagaatgcagtacattaaaacgtgaatggaaaaaaggaaacgatagtgacatatatagacatctcttttgagaagtttggcttctcatttcacacagaataaaaacctagttcttataatggcctactgggtcctacatgacctataccccacatttcataaccccttcttcactctcactccccaccactcagttttcttctctaacctcagcttttactcttgtctctcttgctttcttcattacagccacactggcctcgttgctggtttcagctaggccgggtactcccgcttcatgactgttgaactgcttgtttactctgcttggagtgttattgcatatatttgcgtggatacccttcacgtccaagtctttgcttaattgtttccttcatagtgacacctggtctatgctatttaaaattaaaattatgctgccattctatccaacgtgccagtgccccttatctgtactttttcttttctttttcccatagcactttcacctctttatgtattatgtaatttatatactctactatttatgtcacttccttctttattatatttgttgcttattgtctgttggaatataaactccatgaagcaacaattttttttctgttttcttcattgacatatcttatgtgccttagaataacacttagtctgtggtagatactcaagaaattattgttaaataaatgaatgaagaaacaaggcaaggcttggaaaaacacatacgctgttttacccaacagctttgtgaccttgggaaaattatttaaccttttttttttttttaacagtccagaagtcttttatttttttaacacctattatgccatgaattcatagggaataggttccagcagctcaggctccttcccactggttctcacaaaatatgcttctctgggtggagcaggctggcgcttcagttgaacccaggtacctttctctttggcttctttctttttctgatcattttccttctttttctgataactttccattttctgatagcttcctttaggaagctatctcggctcttagcgtgcttaacgtgctgaatatgcatattaattctgttggcaagaatcttgcccttaacttttttgtttacaacaatgccaacagcatgctgggtaacattgtagacccttccagttttgcagtggtaacacttgtggggcattccttttgaacagtacccattcccttgatgtctacaatatcacctttcttacagatttgcatataggtggccaaaggaacaactccatgctttctaaaaggcctagagaacacgtatcgggtgcctctcctctttccctttgtgttcatcattttggcaaattactggaagatggcagttctggctgaaagactttttgtttgtttgtttgtttgtttgagacagagtctcacactgtcacccaggctggagtaaagtggcgtgatcttggctcactgcaacatccgcctcccaggttcaagtgattctcctgtcttagcctcctgagtagctgggtttacaggcgtgcatcacggtgcctggctaatttttgtgtttttagtggagacgggatttcaccatgttggccaggctggtcttgaactcctgacctcaggtgatccaccagccttggcctcccaagatgctgggattacaggcatgagccactacgcctggcctaacctttcagatcctcagtgcactcgcctataaaatagagataattttgtggattaaataacatttagtatgatatgtaatatattggaggtcctaaataaatttttcttttcctttcctcgtctcaaattttattttcttactttcaaaatcatagctacaaggctctccttgtcactcagtgcttctttctggcttttttccctctttttaagagatcaggtcttactgtgttgcccaggttagacttgaactcctgggctcaagcagtcctcccacctcaatcttccgagttgctggaactacgagcacatgccactgcgctaggctctattgcttgtttctttgtttcttcatatattattgtaatgagtgtttatttatcaagcacctattacatgctgcgcattacttcagccgttggaaaacatagcagtgaatgaaattcagtggaacagataataaactaaataaattatgtcaggggttaggtggcaataagtataatgaagaaatataaagagcaagaaagggtgatggtgacagggactgcagtgttaactggggtgattagggaagttcttactgaaaaaatgacatttatgtcaagaactgaaggaagtgaggaaatgagctatgcggatatctgggagaaggcctatcaagcaaaaggggatagtaaatgcaaaaggtcttgggggaacatgtccgacatgttagaggaacacctaggaagctagtgttgctggaatgaagtgaataaagaaattagatcagagaggaaatgggaagccagattgtgtaatcctttattcagtactgaagtggcctctgtggcatctttgtgcaaattggaaaaagatgtttcctctgagcagatttagccctacaggtgtatggcgtggctaaggaagtgtggactggatttcagttcctactcaatgcccctggcacagagcacaaatggtacagtcatacatgatggtcttggccttatagtttattctattcttaaacaagagcaacacctttgtctaagctaccagtgaacacatatgccttcagaagagaactgaaaagctccctcctacgtacatctcatcctccagcttctctgatgtctccattgtgggaatgcgagactcaagacaaccagatgaggtcgttgttaaagcaccattctgaaggaaatgtgagagaggtggttagagtttaataaatttgatagggtggatttaggcttttaaaatggcatattctttgtcattttaaacactgacttgaaaataggtcaaaatattagctgccttttagaaataaccagttaatttgtaatttttaatatatttgagtagactttttggagcaggtatttatttggagccacatatggctttctcttaatctgcatttctagaacaacaagatccacaactaattgtggaatcttattgaaggttaaaattttgcttggaaaagagagtacccagcaaaatatcctaggagccaaatatatatttgattaattgcttcccaggcaagaaaatatgggaactaaaactctgggatctttcttctaagtcttttaaacagaagggggtcttgctgggttgttcaggctggtcttgaactcccagcctcaagtgatcctactgcctcagcctcccaaagggctagtattacaggcatgaaccactgtgcccagccaatttagaacctttaaaaatttttttcttgctttactaagaaagtagtactgccaaaatataattcttttaaaataaaaatgatagtgggagactttttagctattctgtgtgatgtgtttttactactcgaagtatggactccacaaaaattgctaaaagttgttaaatcaatgtattagtatgatggactccagaaatggagatttgtagtaggatcattgggataactttctaaatcttccaagctgagtgtgggtttttaactaatgaagaacttaaagcagaattgcagttttgtagataacaagtttctttgtgagtactgatttcctttgggatttaagccagtattcatttgagtgtaaatgtaaaataagctgagagaccacaaataatggagctgtgaagaatggggaataggaggaaataaagcaaggagtcgtggcttggctatttatgttttatattcctgagaaggacaaaattctcctgtatttaggtgatgtctaagcactaagaaaatagagtataattatgaaatgtatacagatattttaatgaagatttaaaaaatggccttagactttgaagttgttggtagtctcccagaagtcattcttggccaggcatggtggctcacatctgcaaacccagcactttgggaggctgaggtgggtggatcacgaggtcaggagttcgagaccagcctgaccagcatggtgaaaccctgtctctactaaaattaaaaaaattagctgggcatggtggtgggcacctgtaatcccagctacttgggaggctgaggcaggagaatcgcttgaacctgggaggtggaggctgcagtgagccgagatcgcaccactgcattagttcattttcatgcggttgataaagacatattggaaactgggaacaaaaagaggtttaatttacagttccacatggctggggaggcctcagaattgtggtgggaggcaaaagggacttctttcctggcggtggcaagagacaaatgagaaagaagcaaaagtgggaaccccttcagatctcatgagacttattcactattatgggaacagcacggggaagaccggcccccatgattcaattacccgcccctgggtccctcccacaacacatgagaattgtgggagtacaattcaaattgagatttgggtggggacacagccaaaccatatcataaagcatctattattatttttgtaatttttacctgctctctttccatgccgtcctcacataaacaacaaaatagtatctgcaatccattaaggtttcagtgcctgttaataccaagtttattactgccactactggtaataaataattattttaaatttatgggtgggcacagtggctctgcctgtattcccagcagtttgggaggccaaggtgggaggattgcttgagcccaggagttcgagaccagcttgggcaacatggcgagaccccatctctattaattttttataaataatttttaagttattaaaaacattaaaaatttacatttatatagtgccttacagtttctaaagtattttcatatacgttgtaaaattcttgtagcaactcagtgagagggacaagatgactatgacttttattttaccgctgagtaaactttggcctagagaggctcagtgacttaagatcaaatgagaaggctgagactaaaaatcagccttcttttttttttttttttccttagatgggtcttgccctgtcaagtgtaaaatcagtctagaagtttctgctttaatttataaaagcccaggcttcctgccacccaccagacagaataggttaagggttattcacttggtagaccaggagaattttgtatatcaaatacctgatggaaatgaagttttctgtggtatctctgtggacaagatggagaaaaacagggtaggtggctatgtcattaggtaaattcataactgatttggtaaccagagagctgattagtgttactctgaagagagtttttgagggcatgccaaagaattttgtcctcagccttagctcttcaacatctatgtctgttttgtatgaaatacatacaacaggctgatcaaatcattggatgatagaggatgtagggtaactagatttcagattttctcttttcttccttttaagctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattctggacctagtagcttattttttccttctgacgatattttgagtaagcaattgtttgatgatgatattatgatgaaaattgttaggcgtacttaagctgttgtgttggtaatggctttgtgactgccccctacgtttctttatgaagtctttttccttacatttctattgtatggagtattagaagccttgaaataggccttggttctgattccagctctatccctcacttaggattcttaggaacttttttagctgaaaagaatgcaaagcacatagctcttatgtgttatgtaacaggaactcaataaataacggttacattactaattaactattatttaaaaggttcagaggatatgaaacatataacacaatctcagtagggttaaaaacatctaacatgttattaatccagtgggtttttttggtcataattatatggtgactgtgggatgggaatgaggatattatcaataaatcttacccatttacatgccaattatggatttacacatcactatcgatacttctttgcttgctttctgtggccgagccctgtcagactgggattataatactataaataattacttgttgtcatcctcatagcagtgatcgtaagttgtatcttgaatgtattaaaatttagggaagttagagtaccgtttttcactatgtctcatcttaaaataaagaccaaggaggtaatatatttagggctgctgagagatcatttagggtatagtaatagctgtgtattccagacacactttccaccatataggccaggactgatgggctgataactaatagatagaaattaaggaatatgttacttcagagataccagtaagatacagttcagatggcacaaatggacaaagcctctctttttgcttgactttattgtaaaaaaattgcatgtgtagacttgaggatcagaaaaggagatgacttgatttgtagcctttactagttgctgttatctctagagcagggtttctcaagcactgtggtcgttttgggctggattaattgtttgttgtggggggctgctcggaatattgtaggatgtttaacagcatccctggtctctgcctgctagttaccagttgtattcccacagtcgtgacagtaaaaaatgtcttcatacattgccaaatgcccatggcggggcaatattgcctctagttgcaatccgctgctttagagatatttctagggtgtggttttagccacagttgtctccagtttagagaagatagttgccaccttctcactcccatctcttaatcaaggcattatcaggttcttggagcaactaatctgacctcagctctttttttcagcagcaggataacccaaggaacatttgagatgtgtattaacaaagaagcacattacccataaaaaaaggtatcagtaagaaatactccttaagacttgagagagccttctcagctgtgtgcccatgtaggtgtaagcattgtgactgattgcctcagggttatctgcccctggagtttaattttctctgtatttctttttttccctagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccattgtggtaaacccagagaaagggtatgttactaaagtggcgttcagatactgtggcttctgagactctcctcacccttctttttcagcctgttatttatttacctttaagtgtcctgtgctccagcaaacaattcaatattctctatcagtttgtttctgcattatcttaacagttgtcttacactttctctgatttcactgcccagactttctttcctgggccactagtgctttaattctaagtcttaaccacacctccaggaccatttcaactgccacgtcctccaggaagttttcctcgatctacctcatcccagccagatgtgatttttgccccctcctgaatactcagtactctgtatctgtgcctctctaagttatacttagtcctttccaatttacgttacttttaattattttttagtcttgtatttaccactagacatcagttttctttatgatgagaactagtatgctttctttcatttaataaagagctttgcatttaataaatactcaataatcagttgtatctgagtcaatgataaggtattcagcaagtaaagtagcttacttcaaaagagaggaaaaggatgaaatctagacgttaaatataagaagtgatttatatgtaacttctttttagttattaaatagattaattagaaagaatttaaaattttgtgttaaggtctctctagtcactgatctttaatttgtcgtattattctgaaaacatatgtgtgcctatgtctaacactattctgttaatctatgaaagctccctaataacttctgtgtacctttgttgctactattaaaagtagtaaaagtgtcccatgaccttttaaaaatgtaaatatataaatagatatgtatatatttataaaaggatttttatctatacacatttatttatataaaagaggatttatatatatatacacatatatatttatataaaagaggatatatatatatatatttggatacaaggtttggctcgatcacccaggctagagtgcagtgacacaatctcagctcactgcaacctctgcctcctgggctcaagtgatcctcccacctcagccttccaagtagctgggactacaggcacacgccaccatgcctggctaatttttggggtattttttgtagaaatggggttttgctgtgttgcccaagctggtctctcactcataagcttaagcaatacccccgcctcagtctcccaaagtgctgagattacaggcatgagccactgtgcctggtcaaaaaatacgtattttaaaacttttaaaaacaatacttaaaaatactctacctccatttgtcttaataagaatatcctcattttatgtggtttcttactccagtaacttatttttttcctcctttccctctaggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtacccaagaaatatgtttccttattttaatttgagtttttaagatgattcatctattgtgtttttcttgcatcgtattgtttttggcacatttcttggcagttttattcattaaatgtagtcagcatcaggttggttggtgaagagctttttcttcaactgtcaacatgattactcctctgttacttaactacctgccagttttcttgatcttggttctgtaaataatatatttctttttttttgagacggagtcttgctttatcgcccaggctggaatgcagttcccgggttcacgccattctcctgcctcagcctcctgagtatctgggactacaggcacctgccactgcgcccagctaattttttctatttttagtagagacagggtttcaccgtgttagccaggatggtctcgatctcctgaccttgtgatccacccgcctcggcctcccaaagtgctgggattacaggcgtaagccaccgcgcccggcgtaaataatacatttctaatgcatcctttcctaactcttctgctctagtttatgttcttgtcatctgtggccaaatcctagcctctggttgatctccctgccagtttttctccatgaaagtttacacatggctcctaaattttctgaagcatggttttaatgtcactgctttacttaaaaaatcttcagggtagtttcataacctgtaggaaaaaagtctagttgtactcttaagttggtataagttagtattcacctttcacaacctcatcgtggcgtttacctttctggtattttaaccaaattaaattatttgttcgtcttaagatatacttttactttcacatttctctgcaatcttatgtctgtaattataattacctcctctgtccccaatttctgatgtccatatagtctgtgttggcctccctagtgatcaggtaaatgaaattaaaatatactatttgtgtctgtcagcatggcaaaaatatgttaacgttgattattgcctagcattggccagtatggtagaaaattacatgccctcatgtgctttggtggaagtggaaattgatagagcctttttagaggacaatttgccagtaataatcaaaatttaaaatatgcattccctttgatctggtgatttcctttgtagatagctgtcttagagaaagaccgatgtaagtgtataagggtatttgctgagcattatttgtgatagtccttcatggagaaatacattctatcagtgtatggaatattacagtcattcaaaagaataaggtagatctgtgtgcactaacatgaatgatttttaaaaattaaatttcagaaaaattcttaagatctagttttgtttaaaatttgaaaccgtatagtatatacactgtgtatacacagtgtatgtatatataccgttaagaaatgtgggaactcaggccaggtgtggtggctcatgcttgtaatctcagcactttgagaggccgaagagggtggatcacctgaggtcaggagtttgagaccagcctggccaacatggcaaaatgctgtctctactaaaaatacagaaaatagccaagcatggtggtgggcacctgtaatctcagctactcggcaggctgaggcaggagaatcgcttgaacatgggaggcggtggttgcagtgagtcaagacggcgccactgcactccagcctgggttatggaacgagaacgagactgtctcaaaaaaaaaaaaaaaaagaaaagaaaaagaaaaaagaaatgtgggatctcagatctcagatcttcagatctcaggttcttcaacaaagagagagagggaaagagagaagggggagggagggagggagggaggggagagaggagaggggaaaagaaacagacatacatgtcagtattttcctcaagaaataagcaaatatatctcaagtctggagcattagcatactaaaatgttgagactgcttactcctgtatcatgtacatttttgtatgtttgaatacatttataattattttaatctttttttcacattttttttaatgtcttcaggttcaaatgcctcccttccattatgtattctctgattccagacagttaggcacacacttacgcatgtatagttacacgcctggtatagtatattctttccctcatctgatctcctctgtctcttatatcacctctaatttttttttctgggtacctaatgcatttatgtcttttgaataattgttttttccaaaattcaccttctgttgcaatctgaatgtattaggttggtgcaaaagtaattgcagttttttttttaattataagttttaggatacatgtgcacaatgtgcaggtttgatacataggtatacatgtgccctgttggtttgctgcacccattaactagtaatttacattaggtatttctcctaatgctatccctcccctagccccccaccccccgacaggccccagtgtgtgatgttccccaccctgtgtccaagtgatctcattgtttaattcccacctgtgagtgagaacatgtggtgtttggttttctgtccttgtgatagtttgctgagaatgatggtttccagcttcatccatgtctctgcaaaggacatgaacttatccttttttatggttgcatagtattccatggatatcacctctcatttgtacattagttacttatgtcaatattttaaactatcttttgtttttatttttgtttgagaaagggttttgccctgtcacccaggctagagtacagtggtgtgattatagcttgctgcagcctcaaactccctagctcaaacagtcctcctgcctcagcttcctgagtagctaggactatgggcacacaccaccacacccggctaattttatttttgtagagatgggggtcttgctgtgttgctgaggctagtctcaaactcctgggctcaagtgatccccctgccttggcctcccaaagttctgggattacaggcatgagccaccatgcctggcaggcaggtctgtgataaagctcttcatgaaaatgtttcattcattacaattaattttgtcccactgctgcaatgagccatgatcatgattgcaccactgcactccagcctggccaataaagccgagaccctgtctcaaaaaataacccaaaactggtaacttgaaagtttattgttgtataggaattctttgtacattctagatatgaatcctttgtcaagatatatactgcataaatctcccagtttgtgatttaccttttttattctcccagtagtatctttagatgaaaagaaaggtcctaattttaatgtagtacagtttattaattttctttttacggttaacatcttttatgttgtttaagaaatcttcatgggagttgagggatgagaaattacttaatgcgtacaacgtacactatggttttacactaaaagctcacacttcacacttgtacacatcatagatacatagtatatatccatgttaaaaaaacttgtaccacataaatgtatagcaataagaaaaaagaaagaaatgtttgtcttctgcaaaggtacaaaaagatactttagttttttccctgaaatttcttcatttaacttttcttattgggatctgtaatccatctggaattgattttggtgtgtagtgtgaggcaggggttaaaatgcatttttttccacattactgttggattcagcatcatttactggaaagactgtcctttccctactactctgtagtatcaccttggtcataaatgaggtgactgtatttgtgtgtgtttgtttctagactctgatgttcccttggtcactttgcctttacttatattatactgtcaattattataactgcaatagattcatctgtgtcttcagtattttttcaggattaccttggctattgttaactaccgcaatttccatgtacattgtagaatcagcttgtgagtttccccttccaaaaaaaatcacatactaagatgttcattgggtttgcattaaattgatagtttagagagaattattatctttataatattaatcttctaaaccatgatcatggtaaatctccctgtttatttagatctttaatttctcttaatgttttataattttcagcatagaggtcttgcctatctttcattagagttgttattccttcttatttggtgcttttaaacgctagtggtaaagactattctaaacttaatgttttattttctaattgtgcctggaatatggaaatacaatttctttttttctccttctagcatattagcttgtaccacaggaccatgctaagtatacttatctttaggattttttatgttatagaatcatgtttcttcaaataatgagagttgtgtttttttctttccttatactggctggggtcccccagtacagtgttgaataggatgataatagaatccttttttgttgttgttgttttctaggtcttggagaagcattcagtacttttgtgattaagtattctttgctaaggtttttctgtagataacctttgtcaaattaaggaatttacttactttccccagtttactgggataaataaaatctagcatgatatattattcttttttttattgctggatttgatttgctaatgttttgagattttttttaatctacgctcatgagaaggattaccttataattttcttttcttgtcaggtatttgttggtgttttgccatcaaggctttgttggccacataaaaagaaatgtttgttctttttctattctctgaaaaaggttactgtcaagttgattttttttttcttacgtattcacagataattatgctttcatcctgggacctttttctatttcgtatttgtagccacccacatagccttttatagcgaattgcatccagtgcatgcttagtttgttgaataaataagcatatcttttccttgttggttccagtagcttacttatttttcaccagcatcaaagtagatcaggtccttaccatatctgggggcctgcagtgacactattgacttccttttttacccagttgtctacctcagaccatcctttcattaccgccagctaatctttaaaaatcattcttctttattgtttaattttaattttcattaaagtaatacatgtaaatattatggatatcaaactgttctacctggcttgtaacaaaaaacaagcctactgctctactctgctgctctcagttcccatgcttagaagcattcacaactattttcacttattttaaaataaacttgcttaaaaatgctatttcttgatttttctcttttagacgttaaacattgacttcctttggaagataaagattttgctatcttaaaccatatgtcgccaaaatacacgtgtgaattttctttccatcctccccagcatagttatgaactttccagaattcgaggcacaagtttgcagatagaaaggacccacctgtgactagtgccataatttttttaagtctagacttaattacttattatttatggctatgaacatattactgttaggtacatttctttctaaaacttttttcctccctgcagagttaatacttgtgtaatgtaaatattgtttcaataaatggatatgcatcaagcagtccatctatttgtcttcataattaaaatcacatctctgggtttcttcatcatcttgctgcagtctggatttgcttggtttctaggctaacttcatttctccattgtcctgggagtatacagatgctgaacctgctatttcctggactccatttcttctggttttcttaagagagaccattttctagcagcttcttgaaaggggctcatcataaaaggttaaaattcttgatcttgtttgaattttttttcctcctcacacttggttgataatttgctttcatgttttatagctgttttctctcagaatttcgaaaatagaactccattgtctttgagcatcttgtgtcattgggaagtttgatgtgactgtgatttcagtctttgtatgctgtccttttcctttttcctccagaagcttttaacatgttctttcccctcaatgtcctagaatttgatactgtgcctttgtttgattcctcccttctttccttttttctttctctccactctccctcccccagccctttcctcttcccctttctcatcattcccttcttttccccttctccttccccttctttcccttcttcttcctttctagtccttttccccttgagcttgggggaagcattcaatactttgtgattaagtattctttgctaaggtttttctgtagataacctttgtcaaattaaggaatttaacttcttttctcagtttgctggaataaataaaatttagcatggtacattctttttatttattgctggatttgatatgctaatgttttgttttaagatttatttttttaattggccaggtgcagtggctcacgcctgtaatcccagcacttttggaggctgaggcgggcagatcatgaggtcaggagttcaaggccagcctggccaccatggtgaaaccccatatctactaaaaatacaaaaattagcctggcatggtgacgggtgcgagtaatcccagctactcaggagtctgaggcaggagaatcacgtgaaaccggaaggtgaaggttgcagtgaggcgagattgagccactgcactctagcctgggcgaaagagcaaaactccgtctcaaaaaaaaaaaaaaaagatttttaaaatctatgctcgtgctttcccttccccttcccttccttctcattgaactggttactaggttgatcctttctgtctagaagtctacaccttaaattctggaatgttttcttgtgttgtttctttgataatttatttttcattttcctattttggagctttttatttttatgctgaaccttcttgactgtagctgtatttttctcacctattatccatctctttgtgtttttgttatactttctgaggagagcttctcaaatttgtctcccaaccctcttgttgcatttttctttgaaatttttggatatcatgtttttaatttccaagggctcttttttgttctccaaatgctctgcccctctgaagacagcctattctttaggttttttgttttttttttaattggtatttatttgttttcttctgcttttgtgtctttttctccaagttcctttgttgtgtttgtcttgggcttcaaatttaaagatagaggttttctttaaatatttggtgatccttagctgtttgtatttagtatgaggcttaaaaatactgagaacattgctgtgtaatttcttacacatattttcaattagtactcctctttcagccccagccacataactcctacctttgttccattctaaaatacctggtgcttccactttctgagctaattaatttcattgttagcttcactggctgtaggcctttagctttctctgggctactgtgtcattatccctggtctatctattctccagcttccaaaatttatatcactttcctgctctcttctgttcttctgccttctttgtccttatgggtttataccttcaaaattattttctttttctttctttcttttttttttcctgagacagggtctcactctgtcacccaggctgcagtgcagtgtgaacttggctcactacagccttgacctccctggctcaaggaattctcccatctcagcctcctgagtacctggactacaggcgcatgccaccatgcctggctaatttttatattttttgtagagatggcattttgccatgttgcccaggctgatgtcgaactcctaggctcacgtgatcctcctgcctcagcctcccagattactgagattacaggtgtgtgccactgcacccggcctaaaattttttcaatcaccatattagtagagttttaggagagaatatataagtaaacttgtgcttagcctaccatctgaatgttgactcaggcaatgccttcccatctggaatatctccccacttttcttcatttattaaaaagttggcattttgcttgcctctttcctgaaactttccttgatacttccaaaatatcagctaatgtctttgtttgactgaactcatgacttaggaaccgtgaactttctataaatatttgaaggactgttatgaaaaagaaggaatgagtatattttttctttttgagtgagggagaaactgaataaagcagggtggggggtatgaacacagattttagcccactgtataaaagaactttctcactgtgcaacaatagcagaagttgcctcctcagagtctggatgactctatgtctgagatgattagaaataattcttaccttggggtgagtcagtcattttttctaattgtgttctgagaagccaggtggggtgagagtgaagctgttcttcataaatgcctcaggtatactcagaactctgggtccaccaccactgctcctccagagaagtgccatttttatctgttgtatatataagttagggtttttcaaactactgttctaagttcttttctacatttctatgaactagaatatttactgcacattgggcacttacttgctcttgattgcatattaatatctagtttattagctgttttctagtgtatgtcttaccatgatttttaagttttgtggtagagatcttgttttttttttcttttctctacctgtagaatctaactggtagtcagtaaataattaccaaaagtataacttgacccacatgagtcatttctgttgaattttctccttttccaaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagtaagtgttaatgggataaagctaattggaggaatcatgtgttataataaattaatatgtacttttgtggatttttaaactctgtttccttgaagactttcatgcacttttagttttgccatttttttgaactctccatgcttttttttttttggagacggagtctcactctgtcgcccaggctggagtgcagtgtcacgatcttggctcactgcagcctctgcctcccgggttcaagtgattctcatgcctcagcctccagagtagctgggattacaggtgcatgccaccatgcctcgctaattttttttttttttaatttttagtagaagcagggtttcaccatgttgtccaggctgatctcgaacttctgacttgaagtgatctgcccaccttggcctcccaaagtgctgggattacaggtgtgatccaccacacccagcctcttcatgcttttaaagccttatgtcaaccttacccgggagcttttccaaattaaacataatctcataaaccagaaatgggggaaaggcatgggtcttgcctgttaaaaaagaatatttcctggtacaacaatgactgcttatcatgccttgtttttctctccttcagttcctttgggaatactgataacataaagcatctatttcttttcttccctctctatacttccccccatagcttgaaaaaaagtaaaaattatataatgatgaatatagttataatgggttaatcttattcttaggcaaaacaaactaaaaattagtgtgtaaacatagagaagactctgtttaattagtaggtgcttggtttttttccccccctttgggataaatatttcaattcccagcttagaaaaatagccatctccatgagccccaggaaaaaagaaaagtagccagaaatattttcttatttttttttgaaaatggctagtcatcttggcctagttcttaattcatatctgtcatcaaaattaccctaatcatagagaggaataaatgagtttatatatgcaaaacgttttttaaaaagtgccttcctagcagtcactactgttgatcatacatgatggtaccggggatgccaatgttaaattgagtatgagagagacaattattgaaattctgtaacttctcagctcagtgcttttaaattgaatttaagcatgaaaggagaatgaagaaacaggagtagccctgtacaagtgttcattatgttggtacagttcatgaatttagaagtaaagttacaagtatttgagaattagaaagttaaaaattgttgtcattttatggtatgacttgtagctcaggctgaacatttaatagaaatatgataatgatatcatacctaagttatttatttagtcgatacatgaatattttattacagaaaatctcaagattttcagaatttcaagggagaggttttatttaataactatttaaatatgattgtatattaggtaaatcattttttcaaatttctaatattaaagagaatgggatttttatcaaaaatgtcatggaattaaaggttgagaaacactgctacatagactgtatattctatataatgtgtgatgtctgttttggacagtatgctcatttgtagatagctgactccctcagtctcaacacaaactgaagcagaaccaatgttattgtggaagagagtcaaataataaatggtggcttatattagatgttcatattttgtgacgacagatgtcaagttgcttttaatacaggctaaacagaaaattccaaacaatgattctttaaaaatacaacttgtgaaacagactttgaaaagttgcctagtggtttctttacttagcccatgtatgaggaagttagacatttatagtattacaagttaccttttgcagttgaccaaataattttgtttctgaattgttctgttacatgtgccttttaagtttttttcttctaataactctttaattctcaatggattcctcattaagatacactttttgactgaagttgtctttcagatatacggattttctgagttaaaaatcttaatataggagaattcttatattttaaatagaataatactcaagtttcagcattctccctagcaattttttgttgttgttttttgtagagatggagtcttgctctgccgcccaggctggagtgcagtggcactatcttggctcactgtaacctccgcctcccaggttcaagcaattcttatgcctcagcctcccgagtagctgggattacaggtgcatgccaccacacccagctaatttcttttgtattttagtagagacgggatttcactgtgttgcccaggctggtcttgaactcctgagttcaggcaatccacctgccgcagcctcccaaagtgctaggattacaggcgtgagccaccgcacccggcctctccctagcaattttttagtttcagtaaacatttcttcatattcacaaaaattaagatgagctttaccattatcttaaaatattttatatataaatatataaggacagtggttagatagaagtagtttcttgtaggttgtgtagagattgagtgaagaatcatattgtgtggaaataaaagtccaagctggaccaacctgaccaccatggtaaaattccatctttactaaaaacggaaaaattggccaggcatggcggcagtcacctgcaatcccagctactcgggaggctgaggcaggagaagcacttgaacctgggaagcagagtttgcagtgagccaagatcacaccactgtactccagcctgagctacagagcaagactctgtctcaaaataataataataataataataataataatgataaaagtaaaaaaagtccataataataataataaaagtaaaaaaaaagagtccaagctgattatacatttgattttcataaatagttttgacagggttgtccctttttctcttctctcccacttctctccccctccactccccctcctctccccatcctcacctcttctctttgcaggacagcacccttgtgctcaggataatggtggctgttcacatatttgtcttgtaaagggggatggtactacaaggtgttcttgccccatgcacctggttctacttcaagatgagctatcatgtggaggtaaatatgttgtaattttcttgtgcaaccctaaatgcaaacatattccatatcttaagcctagacttctatgactaggcattgaagttgctctgtctactaacttaattggttgcgtgtgttccattcatttgtattgtactaggcttttctgttattcttctctgccaccctgcccagcctcataatcatcattttactctgtttctttgacttttttacactccacgtgtgagatcatgtagtatttgtgtttctatgcctagcttatttcacttaacaggatgtcttccaggttcatctgtgttgttgcaaatgacaggatttcctactttttttgactgaatagtatttcactgcgtatatattaccacacttttcagcctgtgaatgagtatgcttcctaatattaaagtagcctcccccctctcccaaaaggtaaaaaaatgaattaattctacctcctgtaatctctctccactaaattgtagattctctaagtttatgtgtcattgttgggaatgtgtctgatggaaagaatattcttttgttcaaatccatcagcaaattcctgttgcttctttatctagtaaaaaatgattttttaaaagatatcactgagtatagtgatactgttgtagtaaaattggtttaatcacttagcaggtttaacaaatagatacattccattgttaaattatagtatgatggtatcaggcaccacaatagtattcatacccttaattcagatatcctccttttggggataattctaagttaattcaactgaaggaaaaagactacatcatactattatctacagtggcagaaatttttaaatgaatttctaatggtgtgaaaattattaagtaaaataactgagtttatacagctattaaatgttataatcatgaagttgatgtaaaaatgttgccaaaatgacaagtacataaaatatatatttctgtaaacaaatattgaaagagaatatgtattcaacatataaaaattgttgatcgggtgggtgggattacaagtaaattttattcgtcgaactataagttttttaaaaaataaataatgcatgtattcagtagcagctatgggcactgtgcttggaccgtaggggatttgaagatctttgagatagcatacagcgtagtcagggaaatcagatatgtacaaagagttaagctctggtacttgaaatttttaaaaatagggattgcacaataatgtgaatgtacttaatgtcattgagctatgcactttaaagtggttaaattggtcaattttatggttactttaccctcccccccccccccccaaaaaaatagcatgtgtttccctatcagggtgctggagtgttactttgaggcaaatcctagaaaaatttctctttatgttaatgataacatggataaaactgagtcaaggatctcatcttccagtttgaaaatatcttttaaagggccttttttcttgcttgcacatttagcaattatttttaatgtatgtattaaaacgagttttgacagatgtatacaactgtgtattaggccattcttgcattgctataaagaaatacctgaggctgggtaacttataaagaaaaagtttaattggctcatggttctgccggctgtattgttcagcttctggataggcctcaggaaactttgatggcgggggtgaagagtgagcaggcaggtcacatggcaaaagagggagcaagagagagagagtaggctagagggagtgccacacacttttaaacaaccagctctcccaagaattcatttactatcaggaggatagcaccaaggcatgagggatctaccccccatgatccaaacacttcccaccaggcctcacttccaacattggggattacatttcaacatgagatttggagggacaaatatccaaactatatcacacggtttgcatgacatgcagttcaaagtagtgtcctttgttttatgtttattagtttctttctatccccaaccaaattcaaactgctttaaggacgtggatatattttatctactttaattctccatacaatatagatagtatagtgctgaatacataataggctcttattaaataatccctaaaattccccatgtaaaatgttcacctgtaatctgcaatattctctgttgtaaagttacagggttttctgacctatggtcacatcataaggttatgggttctctagataattcactaacagacaagtgtaaataactactgtataatttacctgtcagtcattctttcaagtaaaaatgacattccattttgagttggatttacaactcaaaacaaatgctttcccattagaaactaccacacttaggtttgcaacatgagctttatgcataattgccatttgattgatcagactattaaagaggcatacacttgggttgattttaatataattttttattgattcatcaataacattcttaagtgaaattggtctttttgtgtgtttgtttaaactgtgcacatgtggctgtgtatagtacagtgattactaataaagtttgttgtcatttgcctgagtctgctaaggtaccaagttttattcactatttcttttgcagcatcagtgcaaagatagccaaaaaaaagcaatgacatcttaatgttattataaaaatagtttttacctagtgggtcccctgaaagaggtctcaggaacgcctaagggttcatggactatcctttgagaagcttagagctagaaaacttttgagtgctaggctaactttaaagtctttggtaattatactgattattcctaggttttgtgtgagactgtaacggattgcaaatattacaatcctgttttggattacaagatatgaaaaaacttttgccttatagttttgcgggcaaaagtttatagtgaatgtaaaggaagtaatgtgaaaacctttatttcttctttgaatagatgagatagttataaatcatatttattataaagtattttgtgtatgttaattattaaatgagcttcactcaggtatgtgtttgtacttctgtgtgaccatgattgtgtttttgtcactccccttctccttgttcatttgaagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaaggtatccagaattcttcagtgcctcagcatgcaatccttttttcccattcagttgtttaaacttcagtattacttggcttagtgtcagttggggtttttcaagtacatatgactgtatcacttctgatcatagtgccatgttccatattattgttttaattcactccatatgcataagatttatacaaattaataagctttgaaaattgagaaatgaaactaaaatatattaggccttcagtatataaaaatagtccctgtttccaatgagctctgaattagtggatttattaattacgctctaacatattttatattcttcactttcccttactaacttttcccatggtaaaaacaacccagccaagttctctagaattctttagtgaaagagggaatttaatgtaaagaataagccgggcgtggtggctcacgcctgtaatcccagcactttgggaggccgaggcgggcggatcacgaggtcaggagatagagaccatcctggctaacacggtgaaaccccatctctactaaaaatacaaaaaaattagccgggcctggtggcagacgcctgtagtcccagctacttgggaggctgaggcaggagaatggcgtgaacctgggaagcagagcttgcagtgagccaatatcgcgccactgcactccagcctgggcgacagagcaagactccgtctcaaaaaaaaaaaaaaaaaaaaaaaaaaaatgttaggaaatttcctgctggatttttttctcctactcttttttctctctctcaaccaatggaactccagagaataatatttaagttatagctaaaagtctaatttgtttttcatttgtgttcagaaggcaccttttgattcttgccagagtttgactttacatgatattaaaaataaggaaactatttatgttttttttccagtgctttgtttaattgatcagttccgctgtgccaatggtcagtgcattggaaagcacaagaagtgtgatcataatgtggattgcagtgacaagtcagatgaactggattgttgtaagtaggactgagatctataaattactcttaacagagaatttaaacaattttttttcttatgtgtgaggtttacttatcgagatttcctttctaagtaataagtattaatattaagctaattatttgtgtgaaggtttttttatgttttgctttcagtaattctttaaacatagcagttttcttatgcacagaaatcttcacagaaacatttagtaaagcactagaaaagagtaaatattattttactataaccaaagttacaaaattctcaaatcatttagatacatagaaatcagccgggcgtggtggctcacacctgtaatcccagcactttgggaggccaaggtgggcggatcacttgaggtcaggagttcgagaccagcctggccaacatggtgaaaccctagctgtactaaaaatacaaaaattagccaggcgtggtggtgcatgcctgtaatcccagctactgggaggctgaagcaggacaatcatttgaacccaggaggcggaggttgcattgagccgagatcacaccattgcactctagcctaggcgacagagcaagactccgtctcaaaaaaaaaaaaaaagaaaagaattcaattggtctgaattcaattcagaacttaagcaatccacccactttggcctcacaaagtgctggaattacaggtcttcatcttcaaaatgaagagaatgatgcttaacctgatgcctataagaaaattaaatgatttaacatatatatcatttagcctaaaaaacacatagcctggttcatagtagatacattgattatggagtataagtgctgtaatagaaatctacacaggtggcagtagaaatgagagagtagtcagcttattagggacaaagatggacttgatcaaggaaggcatcttagaaaaatggtatttaagattgggtgttgtgccagtgcgctggctcacacctgtaatcccagcactttgggaggccaatgtgggcagatcacgaggtcaggagttcgagaccagcctggccaacatgtgaaaccccgtctctactaaaaatacaaaaattagctgggcgtggtggcgggcacctgtaatcccagctactcaggaggctgaggcaagagaatcgtttgaacccgggaggtggaggttgcagtgagccgagatcgtgccattgtactccaacctgggcgacagggcgagactccatctcaaaaaaaaagaaaaaaaagactgggtgttgatcaatgaatagtgttcatcatgtagataattggagaaatttcattttgggcagagggaatatactgttcaaaagcagaaaagagtgaaacaggcacctctgggaaactccatgtaatgggactgccaaaatacaggctctgttgaggggtgtcagcaagagataacataggtaaaggtacaatcatggaggactatgcttttcttctaaagagcctagacaatattaacaatggggagtggagagtcactgaaaatttcaagaaaaagactagcatggtcaagcaatacagaagttgtaaagccagtgggttggaggtgataagcttataggcagggaaatctgttagattgattgctttcaaacttctgatcgcatcaagaggaatacagagatgtgagctcatgcatttaaaaaggtgtcacacaacacttaaatatttacccatgttatatagaacactttctgacattttctgttttattttttcaaagctggttgtaacccactaaatcattctcaccatttacgaatgacttgcagcctgtaatttaaaaaggaagcgattagagtttaggcagaagatgataaagatctaaatcatgaggaggaggagtgggggtggcagggagagaacagatttcggagttgtttcagaagtagaataaagaggaattggtaaccacttagctatagttgataagtttaagttgacccacaggtacctcactgagtgactggagtcattaaatgggatatatagcaggaactgaaaaccaaagtaccataccacatcttggctgcagatgtaatgtttgattgatgtgatgtttaatttacattaaatgcctttaggcaggcgtgtactttgccacaagccccatcactttttattatcttatactagatgactttatttatggtgtctttacccctggaatctaggagaaatgactgatcatggtgacagtgagttcagtttgtgatatgttgcctgagaggtactcatggaatatcccactgaagctcttcaggaagttgattataaggaactgtggctcagaagagagatttggtgctcattagtttattgataataatgaaagctgtgacagtagatagaatctcccaggacagtaagaagaggaggaaaatagtaggtgatagatagaaatctctctgggaagcacctgcacttaagatgcaggcagaagagaatgaagccaacaaaggaagcagagaaagaataatcagaaatagtaaaattaagagagtggtatcttggaagaatattgatcagacttttttttaaagagaagacaggagccagcagtattgtgtaaagaggttagtgaaatgaatatattgaatatggcaaatagtagaactttgactgttgacagaaaagtttcagtgcagtggtgagggtggaagtctgatttcagggagtttatggtgtgacccagaggctagggattgagggtagtgaatgtaaacttttctttcctgaagcttggcattgcaaaggaatgttaggggactaaaaaggaatgaaaagatgagacggttgttctcaaggactaagaagagtctatgcttcagattccacagactaaatttgtaaatgataatccctacatattatgtaacttagagatgtcattttcacgcatttctttcatataatctgtcagaggatgagtttagctatatggatgggagatttgaggtaagatgaagcaggaggaagttttttaaaggatctgcaactgtgagataaaatttaactgttcagaatggaagaattttccctctgaatagagacagtaatgctctaatttcaataagctcactttccctctacctctgatattgatgccctctgcttcttaaacgggtagctcagggatccagggaaggtgaatccctggggtggtgtcctcttctggcaatgtggcctttctttgtgagtcctccagtaatcaggtattaaagaccttatgttccttggtctcaggcaactagacagcctgaaggccagcagcataggggatttgagagctgaggcttatctttagcttccagttttcattcatcaggcctaaatgtcactattcaaatctaaaatctaacatgtgctcagagctgattttggcttcttcaccattccaggtaaaacatttgatgacttttctaggtttatcccttctggtcataaattttttcccgaaatcttggaataccgttgttcatttgtatggtatatagaatgaagtagaatggattttatctgtttatttatttaaagcttcttaatggtgtttaaatctgtacttcatttaccatctttgtttctatctgtttacaattacactttccaacctattgttttatttctgtcttcatttaagggtagttcattttgattcctaatgatgacatttatttcatatgtcttcagggcgtggtatgtatgtactcataaaaaagaaaagtgtttatgaattatcttcattaggcttatagcttcacatcctattagcaagccctcttttgattactattttgaatatacagttgtttttctattaaataaccatactgcattcttcattgtagatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggtgagtcaggatggatccattgagaatcaagtctttggtcctgcaagactgccagtttccattgtggaaaagaatactacctagagtctgtctgaaaccatattactctgagtttaaacaattataaggacaaacgttcttttttactattagcaccttctctttacacagaaggccttagatatggtttggtagaaattgtcaaagcatataaagcaaatacatatgcaagctctaagcctctctgactgcaattctggatgcatgctacggaaggtgaatcagccagtcatttagtgaaagagttgtaaaccacaggttaagttcaccaccagggaactctagtactatggagcccatgaataaaaggaggccaaaaattatataagattcccttcagccaacaaagatttgtaaatagctggatgatagaagggagaatatgtcttaagttttctcctgacttcatgtgctaataagggacaaagggctagtttaggcatagctgagtagccagaagttttaagcttgggtaggccgtgttgctctagggaactggccttctttttaatgttttctggtgcccttagttaaaagacgccttccttttaatgaatatggagaaggcggtgccttgcaaaaaccctctgaaaataggaacttactatgggtgtaactcttaagtagacaaacatggtttttaaactgttaatggtagtgttgctttgttgccatacctattttcagttagtggaatttgggaagcttcttggaaaaaatagaattttttctttagcactggtagttttgattctagcaacatttatattcattagatgaaaaaatattctttcatatgttgtttgtgccctaaaaatgtttttttgttttcttttgagcaagtctggtatttaatatgccctgcctcacaacctctaccctttacaatcctttcaaatcctccaagaggttgaaaagcccttattttaaatagctctgcttctaccaggggagggagaaggtgggagctattcttggccttgttctaggccagctctttcaatggaagcattgacttctagaaaacgttcatttcctttctccattaaatgttttcaattataggaaaagagtgtaagttattttaaaatcagactacttcactgttgatatttgtaatcctactgttgaatgaaattgcttgatacatttttatatatcatactcatcttcagtttttaacctccttttattttaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcagtaagtagtctgttttcctttgaatgcgacatacataagatcttagattttttaactcatttaaatgtgggtgatcagtgatagtaatgtaaaagtagtttttgaatgtaaaatttaggcataaaaggctcaaaggacttaccacacaccaccatccatgcttataaatcttttaagttactgtgtagtaaccagaatacttgaaagcactgggcattaatttcacatttcaagtaaaagtagaactactgaatggtacctattgagggattagggccttcattttatgacttcccaaaagaggaagcacacctggaatttctcctaaatcaataatttttctctaaatacttactattttaaataaccaggacctaaatgtactgaccaatgatttttaggttacagattttcgtttttgtcactttgcactttttagccatgatgaggtcttagggaatgaggaagccatagtcccaaagtactgtttgaggtcaattctttggaaaagaagaattgtgctaatagtgtattgtaaagaaacactaatagagatgaaggaagaaaagttgaaagaaagtctgatagtttctatgttgttattttaatattttaattatttttttcttttagattttgaaccctccaccatccccagccacagagcgatcacattacactatggaatttggatattcttcaaacagtccttccactcataggtcatacaggtaatacacatccttctctaaaataaggtgcagtatttattgaaagtgtttcagttgtggacctgatatagccccaaatgagtagacgatggtcaccagagagagactagtcatcttatcttgatagtactgacattgcctctaccacaaatcctttcctttcaggacgttatactttttttttaattttttgagatggatttcgctcttgttgcccaggctggagtgtaatggcatgatctcagctcactgcaacctccgcctcccaggttcaagcgattctcctgcctcagcctctcaaatagctgggattacagacctgcgctaccacgcccagctaattttgtatttttagtagaaacgtggtttcaccatgttggccaggctggtctcgaactcctgatctcaggtgatccgcctgccttggcctcccaaagtgctgggattacaggtgtgagccaccacacctggcctatacttttttttttttttaagagagtcacaaatgctggcttttataataataaaatacagcctcaggctttggcagtattctaaggaggaattacccaccaaagtgactggtttcaaaatagtttgatattctaagaatgaaatattgggataagattggttcatagaattgagagtttaaaacagcaacatactcagagcacagaattttagaaaagttgagagaaatgtaagttcagccattgcttgcatatgctattacaatttggagtgaaagatttctcatgtagttgcatggaataaagaaagattgaaataaataaagtgtatttgtaagccaaaaaagagaaaattattcctttttgctaatttatgagtctataaagtgtgttgagcaggtcaagtactgttgtgtcagcttccacttctatgttccttgaaaggccaacagaccatcagtagcttgagagtttctatctacacactgaagtgcccagggttcatgggcatccctcaagtgcctgttatcttctagataatcttttctatcttctatcctctctagataatcttctattatctttcctagcatttcagtcaaattggcctgatacgacctcacccatgtgtagaaatgaagtggaaaccacttaaagtatctcactcagaattctcatttcagcttagataagactgaaatagccttggctgtgaactgattgttttaatgatatgttgtaatgttgctttccctgccacaagtttcttcttctaggaagccaaaacagaaaaagcagaagcctgaaaattgagaaaggagaaagatacaaaattttattttttaaaagtaatgtccttaattcaaattgactaaggcactcatcagaataaacacgattgcataaaaaactattcttgcttaactattttccgtataagcccaatttctgtttcctctgagtcaaaacttacatcatttgttgagattttggtttaaactgggacatgaaaaaattttattaattcagtttgttttcttttttttttttcatgaaaatagaagtatttggacttttaaatgttgaccttagaaatttcaccaaggattgacacctgattggacaaagagttaaacaaaacaaactgtgacatcatgtcagtattgatagtaaaagcctttgagaactcactcagtgggtcatataacttttggtctctggcagccttgcaccctttttatttttatttttattttttttgagacagggtcttgctctgtcacccaggctggagtgcaggggcacaatcacagcttactgcagtctccacctcccgggctcaagcagtcctcctgcttcagccacccaagtagctgggactacaggtgtgtgtcaccacgcctggctagcttttttttattttttgtagagacggggtcttgctatggtgcccaggctggtttctttctttctttcttttttaaagactaatcaaatgcagtagtaagaaggggagacagagtagaacaaggaatttgatctgtgactgtgaacaatctggcagccatttcttttgaagcaagccaagtgatatcaaatggtttgtatcctgggttcctgggatatattacctggtggtgctctgtatcactaggtgttttatgaatcgttgtatcagtttttaacttggttttccccttctcttgtagtcactttgatgagaaagcttatgaaaaaatctttgggataaatttaagatcagctttaccatatttagaataaacaggtataagaagttaaaaatagaagtaggaatgacagaaaagccagaacttaggtcagatcttattttcactagtatgtttctctctttccaatgcctttttctttagttagcagtgctacaaacctaacaactgtatgtcacttgtaaagataaacaagtgtaagaaataaactaggcctctgaaatatacattagaaaattcactgaccctttatgggcatttaaattttatcattttgatgtttaaagctgctcttatgagaggtacttacctatacacagggaatgaaaaccgtttcccccaatcacagcaatttccctttgctaagataacaacaatggaatagttatgcccctgaggctgtctaccaaaatccagcctggactgtacagaaattgtacagaattgtacagaagaaagaaatgaagacttcagatgtcattaaattaattattcatcaggttaattttggagtaaagaatgttgagggaatgctgacatgtttgagtagtgtaaaatatgtaaaaacccattcttcccatgggctatgaaactgcagaacaaatttgaatagtcattttttattctgtgatacagtttaacttgaagatgtaagagcacaaccagaggctagattgaattcacctctgcattcccatcctgttcattttcacttgccactttcttatttgcaaataagaaagtacctgctattttcctcagcgaatctgccattgaaaattgcctcttggtctgtgtaaatttaaattgcagtagcttattgttttcatagggtagttgacatctaatacctctattctgagaggggaaatcatttttttttgtaaaactaactgcttctctttattttctccctataccagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaaagaggaagaagaaaaattaagtccatctcagagcagcaaaccatagatacatggatgtagccagatagccttcagttaactaacatttgagggccaacaagtaagaaatgatgaaaggaaaaaaatgcaattaatactaaccttggacgaagggctttgttttctctaggaatccaacagtgctagtgaggaaagtagatatttctaaaaacccattctgggtgttgctgttgtaggagagatcagccctctggtaagatgccatgaagctgtgtgtgtgtgcaagtctctgtccctacctttagaatccatacctctgtcaaaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccattatgtttttgttgtaaatctcatatccttgcactactttcagcatatatcacagtacgaaatcatttatatatatatatatatatatatatatatatatatatatatatatatatatattttgtttgtttgtttgttttctgagtaaaacatttaaatatgttctggttagagacaatctatttaaaaagatttttttcttattaggattttccctatattaacagtttgtgatgttttcatgttctttagaccggtttttctcagaataatgtctacatacatacctcttctaatgtgtgacatgaatttaatatctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagagtcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgt

SEQ ID NO: 14322 - DNA, 5414 bp, Human
ttactaagagaccaatcctcattgaggatagttaatgtgccactttctgactgaaaggtttgagagtcagacctttaagaagccctgctgtcacagagttgacatcgcatggtgccaactttgttggtccctccattctgcctccgaatcctcactacatctaaaccctccctcccattcctgccttagaggcaaacgcctcaagaagaggaatgtggtcagcaggttcaaatgacaaaagaactgaaaagtatccattggggaaggggttggggatgacccacaccaacctgactagagcagtttcagtggcacggtgagctcccagggcctggttcttgtgcatgccgctattccattatgggtttaatttgcacttcctcagtggataatgctgttgagcccctcctttcgatatgtgttggctttttaaatatcttctttgggaagtacctgttcaagacttttgccattttttagctgggaactgatttttgctcatttgtaggattctttatatattctggagacggggtttttttagatgtttgtattacacatatctcatctgcagcttaccttttcactctctaaatgatgtcctttgatgaacagaagttcttaattttgataataacttttctttatgattagtgcttttttgcccagtttaagaaatattttcctaactcaaggtcataaagatatttttctacattctcttccacatatctactattttatgtgtatgatccatctgaaattaatatttatggtatggagtagaggtcaaaatatttttcatacaaataagcaatttgttcaacatcatttattgaaaaggccatcttcctctctctcccttgttttgcagttgaacatttatgataaatccgatgatcatgcatgttagtgtcttttggactatgtctcgttgtatgcttttattattgtaacaataccaaatattttaaatgaaaactgatagtacagttgacctttgaacaattcgggggttaggagaactgaccccttacacaataaagaatcattgtataacttttgacctcaaaaacttaactactaataacctacgtttgactaggagccttaccaataatatagtcaattaacacatattttgtgtatgtattagatactgtactcttacgtaagctagagaaaaaatatgattaagaaaataagggagagaaaatatatttactattcattaggtagaagtggatcatcatcaagatctttatcctcatcgtcttcacgttgagcaggctaaggtggaagacgacgaggggttggtcttgctgtctcaagtggcagaggtagaagtaaatccatgtataagtggtcccacacagttaaaacttgtgctcaagggtaaactgtatgttttctaattttgttcttgttcaaaattgtcactattttaggtccttagcattttcatatacattgttgaatgattttttttttcaattaccccataccaaaaagctaggattttgttggcattacatcagatacatagattaattctggaaaagtgaagttataaacatgaatattgagacatttaatctatgagtattccaaaacatttcatttatatagatactttaaacattttgggatttggttttgttgttgtttgtttttgagttggatccttgctttgtcacccaggttggagtgcagtggcacaatctcggctcactgcaacctcagcctcccgagtagttgggatttacaggtgcctgccaccacacccggctaattttttgtattttttttttagtagagatgggatttccccatgttggctaggctggtcttgaactcctgacttcaagtgatccacctgaggcaggtggatcctgaggaactaacctcaaaatttcagcaattcttatatttttgcaacaattttttcaattatagaagttgctaaccattgtgtggctggactcggccgccactatggtgtgaggcgcgtgttcgggctcttgccgtccccgcacccgcaccgcggctactggcttgcggtccgccgttccacaaccagcccttgggcccccgcccgccacggacatgccgcgcgtctacataggacgcctaagctacaacgtccaggagaaggccatccagcgctttttcagtggctatggccgcctcctcgaagtagacctcaaaaatggctacggcttcgtggagttcgaggactcccgcgacaccgacgacgccctttacgagctgaacagcgaggagctctgcggcgagcgcgtgatcgtagagcacgcccggggcccgcgtcgcaatcgcgacagctacagctacggaagccgccgtggtggaggtggatacagcagtcggagacatctggcagagacaaatacggaccacctgttcgtacagaatacaggcttattgtagaaaatctttctagtctgtgcagttggagagatttaaaggattttatgcgacaagcaggttaagtaacctgtgcggatgcccacaaggaaggaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagatggtcacgaagtaggagtcgcaggagcagccgcagtagatctggaagtgtctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatatcgaagcaggtctcggtccggatcccccaaagaaaatggaaagggtcatacaaagtcaaaatccagatcaaggagccagtcccgttccaattcgccgctacctggtccaccctgaaaggcccgctctgtgtcccctccaccaaaaagagctacttcaagatcctgttctagatctcgctcaaagtcaagatcaaggtccaggtcgagttccagggattaactcagaactctcttgttgtctgcacactattatggaacactttcctgcttaggcagttactcttccatgtttatacttggtctcttctgcaagaggaatctcttgaaaacaggggcacacagaaatttgatatgtggccaaattggatgaaaaagatgaggtttaaggaaatggtggcatgaagaccctctcccttctttgtagaattaagataactatgattttatagcttttgagctaacataacttttgtaaagattaagctcatttagtttttgtttgtttgtttgtttgttttaagtatttcagccagatctgctggcagggtttttttgttgttttatttgtttgcttatttttaaattaactgttttgagctttgaatgcttaaggctttagagggagaacccaattttcaattatgttggctttttataaagcttgagttatgtaagatttaaatagaagtttgctaccaagatgattgccttattgaataggtcactattaaattcctttaaatgttgatatctgccatttgtggaaacaacgtaaattctactttagtgtaaacaaggcaagcctcagaccagcaataaattattcagtttggataacattattttgtgctgttaatcaaatttgccaaagtctttatctgcccctttaacaagttgagtaaaaataaaaggtatttaaaaaaaaaaaaggaagttactatattttttcaattgtagaagttttgttagattagtactatgcatttgatgtttttgatgtataaatgctattattttaatttcattttctgattgttgccacaatataggtatatggtatatctcattcatatatatatatatatatatatatatatatatatatatatatgtatatggaatagattttttaaagttgatcttatatccagtgaccttgctaaattcacttatttataattgttcattctttttgactttctgtgtacacagtatgtcatctgtggtaaagtcagttttacatcattctttataatcctcataccacttttttcttgctttattgcactggctaggacctccagaaataggatttgtagacatccttgcctttttcccagaatctaaaggaaaacaaaacattttaccatttggtatgacttgaggtgtaaattttagatagtctctatcactcaaattacttttctgaggtttgttatcaggatgggtgttgaatttcatcagacattttttgccactattgagatgattatagtttttcattctgttactctaaattatgtggtttgattttaaacatttaaaaaattgtcataaaatacacgtagaatttataatcctagccattatgtgtacagttcagtgccattaagtcatattgtgcaactatccatctccagaatgtgtttcatcttagaaagctgaaactgaggctgggcacggtggctcatgcctgtaatcctagccctttgggaggccgaggcgggcagaccacgaggtcaggagatggagaccatcctggctaacacggtgaaaccccatctctgctaaaaatacaaaaaattagccgggcgtggtggtgggcgcctgtattcccagctactcaggaggctgaggcaggagaatggcctgaacccgggaggcggagcttgcagtgagcccagatcgcaccactgcactccagcctgggcgacagagcgaaactccatctccaaaataaaaaagaaagctgaaactgaatacccattaaacaatgactctccattccccacttcaccccctaaaccctggaaaccaccatcctattttctgtctctatgaatttgactgatctagataacctcatataagtagaatcatacagtatttgtcctttggtaactggcttatttcccttagcataatgtcctcaagattcatctatacaaattgatttttagatattaaagcaatttgcattcctggaatagatttcatttggtcattgtgggtaatatttttaatatattattgaattaaatttgtcaaaattttgtataggattttatgtctatgtccatattgtcttctgtgttttctttcttgtaatagccttgtttgactttgtatcagaattatggactcataacatgagttgaggattccctttattttgtttttggttttttgtttgtttttggtcctctggaagagtgtgggtaagatgtgtaagattggtattattggttttggtattattttgccataattttgt

SEQ ID NO: 14323 - DNA, 12180 bp, Human; identical to SEQ ID NO: 12527
  misc_feature (1)...(12180): n = A,T,C or G

SEQ ID NO: 14324 - DNA, 112222 bp, Human
  misc_feature (1)...(112222): n = A,T,C or G
acgtgcagggtctatttataagaagaggtagctatgcggtcaagttcagggtgggttcggtggaatcagaccaaccagcagctcaagcagagtttaacgctgcaaatctgtgccacgttcttcttcctgcgtgcaatttgcaggcaaggacatctgcttaattgggtgtgaaacccgggccttgattaaaaggactttatgaggccgcagccttgcatttccaaggtcaggccctagtggagagggcgcgcgttccgcggggagacacgaacttttcctgagtgcgcgttccttgctggccctgaacccctcggccaggcagggcttggcagggccgtttcctgtcctaaccaggatcaagggattgcgcggcttgctggtgaagcttggcagggccgtgacctgtcctaaccaggctcaggggatggcaggggcctgctggtgtcgcatatgttttgcattccagctcaggattttgcagagcatagggagcgggtgtcacccccggggggaaatgccacccacaaaatgcaggtggaggctgggcgaggctggcagccaggggccagaaatccaaagcctgagccaggttcagacttcctgactccccctccccgttagctgtggaaggatggctcggcctggtccccctaaaaatgtgtccgttctgacttagaggccgctttggctctcggaaagcccccctgacctgcggactgagggactggagaccccctccaatcgcagaatcgctgagatccctcaaaacaaaggcgtttgcagtttgaccccttgctgctcaaactgtggtcggcgaaccggcagcctgggccgccctggtcgcgggtcaggggcgcagcgtccaggccgtgccaggcccgcaagttaagcactgtctgcatttccctggggaaaggggtgaccaaatatctagctatatttgcatttcaaatccacacggatatgggttttaaatataagtatgtccaactattgcctgagccacacttaagccaggaaaaaaaaatctttggggtttctgaaattgaaatgcctctgcacaattctttatagggttgtcgccggggtgtttgaaacagtgaccaatcaagtttcacgcactacatttggtcgggcgatctctcaaatctgtctttccctagttttttaaaggaatgtttatttgtaaagaattctagatccacaggaagctgcaaagaaacgcacagggtcgagcccgcccttccccgccccttccaagtagaaatctagaatcaccagagtcctacagcaaaaccaggacgctgaactcatcccgaagacccggcagcccctcttggggatccgccctcattccaaattctctcaggtcccaaacaagcacccgcaggagtactgaactttttggggggagggcagaggggatctgtatgcagattgccagctgagcaatcctattttctatgacttaaagccaatcagaggctgggcgtggtggcttatacctgtagtcccagcactttgggagaacgaggcaggcggttcacttgtgctcaggagttccagaccagcctggccaacatggtgaaaccctgtctctactgagaaaatacaaaaattagccgggctaatccgagcccctctcttcaccaaacgccagtttcactttttagttttgaacttcacttctgctgagctacgccctccctgtccccgggccccctcgcctccccatcttccgggcttgggtgcagcgacgcgggtggcccgccagtgcgtccccgaggagaagtcagcctgggtcccaccccaggggtgccccgggcgcggagggggcgtgggcacctccccagcgccgcacgcccgggtctccggctcctgggctgggtcggggcgggggcggacgcgcgcgcgaaggcgacgccccccagccccgcggccgggttagggcggggagaggcgcggtcacgcccaggcggcttccgcccgccccaacagcgcgcacgcggctaccgagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggtgagtgagtgcgggcggggactcggcccacaggggcgcgcggcgtggccgggacgttgtagtaggacaaagggccctgggtgccgacctcctggggagggccctgacccgctacttcggctcggagtccccgtgcggggctgcacctgcgccccgggtcttcccgggtggagcgcactccccagccccccagcccaggcaagtacccccgaccggccgggtgcctaacctgaaatgccgacggctcctctcggagaccaccctccacccccagcacacacagcactctggggcctgggccgtccgacgtcacaaaacctcctgcgggtcacctcgcctgggggacctcgtgctccctccctggcagcggccccagggacactggcgcggggtgcgaagacccctgcaggcctcccctaggccagcctccctgtgtgcccagaggcagggaatgtacagatttctccaggggctgcaggagcagctgggctgtgggggacaggtgtcccggggcgctgtggggacgaggacggcagcgctggggacggatcctaacatgtcctgacaccgcctgtgctcttcgtcttgtgcctctgaaatgggtaattcttgtatcggacgctttatccgtttcctttgtcctctgtctttgaacttaaccccgaatgggcagcttgacagagaggtttcgagttctcggtgctcttgcatccggacacgcgctgctttatggagcagccctgagtgggtcagaatatcccaactgaacgtgggcgctggatttaaacagttgtcatcggcccgcctgtgccacttagggactccgtatggctaagtggggtgttggctgtcaagaaaataaatgggagagtagagggggctgtcctgggtgtgttggtgaggcgtcggctctcaggccctctaactcctgtttgtcctcattttggaaaggaggaagctgggctgggaagcccaagggctcgaggccatagcttatgacttaggaagaccagcgggcatagccagtggggcctttagaaccgctgaggaagaggggacttagcttccttcagtgacctctttgccacttagaccttgaggaagggcccacgaggaaagcctgaatttggaaggacagagtgggaggaggccctctctctttctcctctccctccctcctcctctttatctcattctctctctcttttctctgtttctcttctctctccctctttctgtctctgttcaagtctctctgcatttctcctcctctgtctcttggtgtctctctccctgtccccttccggtcttggtttttctgtctccctccctcctctctctctgccttcccccttgtcttggtccccccggaaagctgtcctggtctaatcttagagctgggtgtgttttgcgcggaagaagggtggggcaggaaccctgactggcgcagccgccacagtaggtggaaatacaactcgacaatggaaaattgatgaggtccagccgttccttggcactcagcaccagcgtttgtcattctttggggcacccacatgggtcccttgggaaaggtggagctggggctggaggccggggcagagagcaggatgcgggcaggagggcggcagaggtgaggggttctggtgtcacagggggccactcagtttgacgtcaagtcagcttagggtgcccagcgggtaacctcatctttaaaaatagagtgtcgctgcctctggggaccaagctggctgggcggggagtcagctttttttttcagtccagtcagtgctctcttaatgaggatgaggatgatgctcctttctcaaggataacttcctgtgagctccaacgatgtgacaggagggctaggtatcccacactcattggacagcaggggaccaggacccaggggtgtgtgtgtgtatgtttgcatgcacgtctggaacactctctcatgacaactgcacagctttggtgacattatctgcaaccttttatccaagcccgtttctttattgttggttaaagagcaatctgagtgtgattcacctaaaataatacattttataaaatcctaagccttttagatccttcacgattgtgtctctaagccacaatctacagcagctttggactgttttccaaggcgtgatggagaatagtgaggggtgagcttgagtctcagtctggagttgaaacccagtctgggtgggtgtgacctctcttcatcctaaactgtcactacaggaacataagtttgcttttaagtgctctttcgccctcattccgaattctctcaggccccaaacaagcacccgcaggagtactgaactttttggggggtgggcagaggggatctgtatgcagattgccagctgagcaatcctattttctatgacttaaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagcttctcaggaggctgaggcagaggaattgcttgcacccaggaggcagaggttgcagtaagccaagatcacaccactgcgctccagcctgggcgacagagagaaaaagaaacttgtcagcgttctagattgaccagttttcctcaaggtcaggtagttaggaagaaagagtgcagtttgcagttgtgaaaagtctgataatggattctttttttcttttttatgcgtgaagggattctggagtacgtctggtctaaaggccgatttcgttttaggaactttggatcagaacagtcatactagtcctcagagaaaaaatggttttcaatctggttcttcaaatttcttgttcatataaccaagccatgcttgttcctatgatggagaacaattgtgctttaaaaaaagaaatttcagggccaggtacagtggtgcgtgcctgtagtcccagctatttgggaggtcgcggtgggaggatgacttgaggccgggagttccagaccagcctgggcaatatagtgagaccctcatctcttaaaaaaaatagtagtaatagttagctgggcatggtggcgcatacctgagttacctgggaagctgaggcaagaggatcacttgagcccaggaggtcaaggctgcagtcaaccacaatcgcgccaccgtactccagcctgggtgatagagcgagatcctctctataaaaaataaaataagaaaatgatattatggaaatgaaaaactcaccctatgtagagagaagaggatgaatctgtgcagccatctaccagccttattttaccaatttcctacttaaaatgaccacttgagaattcctttctctatatatcagataaaaaatacttgggttttttcccagaagtgtccttatggaatcatttggcatctacaacccagtgcttgcttgtcatgggtaccccaagtgttaacctgtcaggaaggaggtaattcaacaggtaaaccagtggccaggccttgggtccacatttcattttccttttctcagcctagttctgcatttactcatctacagagggaaataatgacggaacctgtcctacacgatgacgatgaggaagactccaaagttcctagacccctattaaaaatatatattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaagtgctgggactatatacaggcatgagccatcgtgcccggcttgttcaggctttattagttttcaaaaggtgctcatttgtgtttgcgagtgtgtgtgtagagttctgtgcagttttacccagtgtgtggatttggcagctaccaccctccaaaccatggtgcaggatgaattccctcaccacagaacacccctcggtcttgctcgacactttttttttttttttgagacagagtttcactcttgttgcccagcctggagtgtattgaccacaacctctgcttcccgggttcaagcgattctcctgcctcagcctcccgaggagctgggattacaggcatgtgccaccatgcctggctaattttatatttttagtagagatggggtttctccatgttgattaggctggtctcaaactcctgacctcaggcgatccgcccgccttggcctcccaaagaggtgggattgcaggtgtgagccaccgtgcctggccagacactttttttttttttaaactttcacacactatacaatctgaaaatattttattttcttaagagctaggagatcttcataattaatgatacatggttctcagatctaaagtgcttatactggtaggttttctcttgtccttggttctcctgaattggccagaatttcctttcctctccttgttgctgggttcttattaatgcctcaagttagtcggttcaggcagttgtagcaaaacaccaccgactgggtggcttataaaccacagacatttattcacagttcagaggctggaggtccaagatgaaggcatggcagatttggtgtctggtggggacctgcttcctggttcatagatggtgccttctcgctgtgtcctcacatggtggaaggggtgagggagctctctggggcccctttataagggcagtgatcccattcatgaggctccaacctcacgacctcatcacctccctagggcctcacctcctgacaccattaccttgcaggtgaggatttcaacacaggaattttagggggacacagacattgagtccacggcatccccaccctgtctgtcacacagcatgctgccgggacgaatggcatctgaactggtgagattctactgtgtgcataaatcagcagccttgtgggcagtgttgacatagcaattaggagtgttgtttgtagcctaacaatacacagaaagtggagctcagccctttgatcttatttaccttatgtgggtgctccgtgtgagacaggctcatgcatgtgtgaatgacagtttcctttaagtgcatcacgcaaatgccaagagatgagatcaaatattacacatcagagaacatttccaaggatagaagtcctgccggtttctcctcttcattgtttatttcattttatttttttaatttaagttaaaatacatgttaaattaaatttaagttaaattaagatacatgtgcaggacttattttaaataaaagagacagggtctcgctgtgttgcccaggctagacttgaacccctgggctcaagcattctgcctgcctccgctgctggcacataaatgccaagtgtgcagggacctctgtgtgttggagccactttcatctcccacatccaaagaacagacccggcacttagtgtgtgcccaagaccatccaccgcatgaatagagaaatcaaccctcctcatgtgcctggggtttcctgaggtgggaaaccttcagtgctagctgggagagtcgcaggcagagacagggacaagctggtcactctgtgtgtgaataaataaatgaatggatgatggcattatcggcagttgttctttatgacactcactgatgccaagtactggacgggtacaatatgtacattagtttctctatgggcagaagctccaccatgacaacattagtgttattttctttttgcttttttgtttagagacagggtcttactctgtcgcccaggctggggtgccgtggtgcaatcaacagctcactgcagcctcgacctcccaggctcaagcaatcttcccacctcagtctcccaagtagctgggactgcagacgtgcaccaccacactcagctaatttatgtatttatttttgtagagatgggcattgctatgttgcccaggctggtctcgagctcctgggctcaagtgatcctcccgcctcagcctcccacgtagctgggactacaggtgcatccaccatgcttgtagccttattttcttaatgggaaagagggtctgagagaagggatgctgtgtgcccaatgggtttcgcctgcagcacgctgcctcctccccgggaaagcagggcgtgcacattgggattggacgacaaaagcagagtcatctacagttcatgggcacgctgcaaagaagggagacgttaaactctcgaaagcagcagacaccccccaccaggaagagacatacttgtaaaaatcaaaggagggcgaaggcatgagaatcgcttgagcccaggaggttgaggttgcagtgggctgagatcgtgctactgcattccagcctgggtgacagagaccttgtctcaaaaaataaaaattcaagggaggccaggtgtggaggctcacgcctgtacccagcactttgggactctgaggtgggaggatcacttgagcccaagagctcaagatctgtctggacaatatagcactaccccatcgctacaaaaaaaaatttttttaagtagctgggtgtgatggaatgcacctgtagtcccagctactagggaggctgaggcaggaggattgcttgagcccaggaggtggagactgcactgagccatgatggtgccactgtgttccagcctgggcaacagagcaagaccctatgtcaaaaataaagaaagtatcaagggagatgagtacacagtgcctggcacactgtagggtctccaaaaagtaaaccttttctatccatcagtttcctcttctctccagcatgaaatcgcatatgtaaagttgaaaaaaagagtgagagatatatcttaaaaaggtagtaatgttgatgacattgtggttttttttttttttttaaagaaaaaccggccgggtgcggtggctcatgcctgtaatcccagcactttgggaggctgaggcaggcgggtcatgaagtgtcaggagatcgagaccatcctggctaacacggtgaaaccccgtctctactaaaaatacaaaaaaaaattagccgggtgtggtggcgggcgcctgttagtcccagctgctggggaggctgaggcagcggaatggcatgaacccgggaggtggagcttgcagtgagccgagatcacaccactgcactccagcctgggcgacagagcaagactctgtctcaaaaaaaaaaaaagaaaagaaaaaccttgggggaaatacagaggaagccctaaggcatcccttccaaaaagctgaaagtgctttacttagaattgtgacctcgttttccctgttagaaaagtctgtggttagaagcttcctggtaagcccagtgtgagaaggtggaaccgatgtttctgtgtgacgggttccctctgcctgtttctccaggtggcctccccgtggtcctctactgtggtgggtccagtcccaaaaccaagtctggggccaccatcatcatatttgtgtcccccaccccaagattcttatgtcaaaaccctaatccccaaggtaatggtgttaggaggtggggcttttaggaggtgatggggtcactagggtggggtctcatgaatgggatcaatgtccttataaaagggaccccagagagctccctcaccccttccactatatgaggacacagtgagatggcaccgtctgttaattagaaagccggtccccaccaaactctgaatctcccataccttcatcttggacttgtagcctccaggactgacagcggtaaatgtctgttgtttctaagccccagtctgccgtgttttgtgatggcagccgaaatggatttagatggggctctattcaccccacgcggcagggtccatggaaaggcagctgcaatgcgctggtctatcattacctcttttatgctctttcacactgtcttagtcttgcgtggctgctggaatgaaggaccgcaaatatagtagcttaaaaccacatacagtgaagagatacctgcactcccaggttcactgcagcacgagtcacacaacagccaagatagggcaacaacccacttgcccgtcagcagatgactgggtgaagaaaatgtggtctctacacaatggagtactattcagcctgtaaaaagaataaagtcctgtcatttgcaacaatgtagatgcaactggaggtcattatgctctgagaaatgagccaggcacagagagacaaatacggcattatctcactccttttttttttggacagggtctcactcggacacccaggctggagtgcagtgacgtggtgtcactgcagcattgacgtcccaggctcaagggatcctctcacctcagcctcctgaggagctgggactgcaggtgtgcatcaccacgccaggctattgttttgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaccagagtcactcttgtcaccatcttggtttgggtgggatttggccagcttctttaccgcaacctgttttatcagcaagctccttatgaccggcatcttgtgctgacctcctatctcatcccgtgacttagaatgccttaaccatctgggcatgcagcccaacaggcttcagcttcattttacccagctcctcttcaagatggagttgctctggttcagatgccgctgacagaactagcttatggttggagacaatgtcatagggaattattcttcaaagatcgcaaaatccagcttggatgagattccaaaaatcaaaaggtgctgagaaagcaacttgtctagaatttcctcttcatgggctggttgattttgtttacaatgacaccttcagaaaaagtaggcgacacacagtggctcacgcctataatcctagtgctttgggaggtcaaggagggagaatcatttgaggctagcagttctagactagcctggacaacatagtgagaccttgtctttacaaaaaataaaatcagccgtgtgtggtggcgcatacctataatcccagctgttcaggaggctgaggcaggaggatcatttgagcccaggagttggaggctgcagtgagctatgatggcgccactgcactccagccttagtgacagagcaacattctgaaagaaaagaaagaaaagaaaaaaagaaaaggaaataaaagatgaagaaagaaaacagaagaaaaaaataatttatatagaaaaaaagtccataatgactcaaaatattccctggacactggaatagaatgattttgtttattaaagcttttctttagttcgtccttaaacagtttagtattttcttttgaaaacagattgtgtcttgtcaacttcattgattttcgggctgggcttggtggctgaacacctgtaatcccccaacactttgggaggttgaggtgggtggagcgcttgaggccaggggttcgagactagcctctagcctcggcaacatggtgaaaacctgtctctacaaacaacaacaacaacaacaacaaacaattagctgggcgtggtggcacgtgcctgtagtcccagcaacttgggaggccgaggtgggaggatcacttgagcccaagaggtcgaggtcgaagtgagctatgattgcaccattgtactccagcctgggtgacagagtgagaccatgaaagaaaagaaagaaaagaaaaaagagaaagaagaaggaaaaaaaaagagaagaaaaaagtaaaagaaaaacatagaaaaaaaatcagtaacgactcaaaatattccctggatagttgaatacaaatagttgttgttggacgtgattttatgtattaaggcttttgtttagtttatccttaaataggttaggattttattttgagaatagattctggtttatcaatttcatcagtctttgcaaagaaacagcttagggtttcctttatgtttctccgttaacttcctgttttcagttacattgcgttttgctctggtttttctttcgttttttccactcgttttaggtttctggaatttcctgaaacattgtattttgatacagattctgagctggtgctttggctgtcacaagccagagggtcctagaagaagtagaattgtaaccgaggaaaactgttaggaaactccatcccttttgaccttcaaaggtcaccgcctaattttggtgttttgtagtctgatgtgttcatagcttgtgactattaggctctgattgagctctgcttttttttaagtttctcttactcagctggtgctgttttagctccagcttcctcctctgtgtaatcaacactcccagtctcctcttcacccaaaaagccacagaaataagtgcagaaaacaaggcagccgccacctgctacagaggcatgtccttaaatacgatgcatttcaggacagctgtgtgagttccgggagcttgtcttccttcaaagggaaaagtaaaaataaacaggaaggttgcactgaaagcattctcaattgaaattgtgccatttggctgtagtgtttctgatgctcatttagaactttggaagttgtgggatggtgggcaagtgtgtgacctgggatggagattctctacctctttaagagtgaaaccctggctgggcgccgtggctcactcctgtcatcccagcactttgggaggccaaggcgggtggatcacctgaggtcaggagtttgagaccatcctggccataatggtgaaaccccgtctctactaaaaatacaaaaaaatagctgggcgtggtggcaggtgcttgtaatcccagctacttgggaggctgacgtgagagaatcacttgaacccggcaggcggtggttgcagtgagctgagattgtgccactgcactccagcctgggtgacagagtgagactccacctcaaaaaaagaaaagaaaaagaaaaactttaaaaaatgccgggcacggtggctcccgcctgtaatcccagcactttgggaggctgaggtgggtggattgcctgagcttaggagtttgagaccagcctgggcaacatggtgaaaccccgtctctcctaaaatgcaaaaaattagccgggcgtagtggtgcacgcctgtagtcccagctgcttgggaagctgaggcaggagaattgcttgaacctgggaggcagagattgcagtgaaccgagatggtgccgctgtactccagcctgggcgacagagtgacactctgtctcaaaaaaaaaaataaaataaaaattagctgggcgtggtggcacacatctgtgacagagcgagactccatctcaaaaaaaaaaaaaaaagaattttggaagttgtgggatggtgggcgagtgtgtggtctgggatagattctccacctctctaaaagtgaaaacctggttgggtggggtggctcacatctgtaatcccagcactttgggaagctgaggtgggcggatcacttgaagtcaggagtttgagaccagcctggccaacatggtgaaactctgtctctaccaaaactacaaaaattagccgggtgtgtggtggcgggcatctgtaatcccagctactcgggaggctgagacacgaaaatcgcttcaacccggaaggcggaggttgcagtgagccgagatcacaccactgtgtatgccactgcactccagcctgagcggcagtgagaccctgtctcaaaaaatacacacacacacaaaaacaaaaaacaaaacacatgtagaaaaaaccacaaagacaaaaacaaaacaacaacaacaacaacaaaaagtgaaaacctacttctttttctggacacggtggctcatgcctgtaattgcaccattttgggaggccgaggtgggaggatcactctcacctttcaaggcccaggagttcgagaccagcctgggcaacacagcaaaaccccatctctctaaaaataaaaaagagaaaaagagaaaaattgcttctttctatgtagttggtgagttttttcagtaggatgctttgcatttcttcctgcgtctgtggctctgtggtatgccagcatatacgatagtcactacaagatccgtagttgtacacccagccatacgcatcacaggtttttggctgatttcatgacaacgcttaaggctgctgaaaacactctaattctttggatgttggcaaatgttcagatgaaactaagcggctggcccacccacctgctcaggaaagaatggccgcattgtgtgggaaaggaatcctctgttccctagctggctgcctggtgttcttgttgagtgagcagaacagagagtgcccctgggtagacctgtgtgtgctccaaaaggcgattttgtcaattgttcccttgggatgcccttgttccagaaagcatgttctgtgtgactctcagctggggttcccagactgtgtaaagaaaacatggtgattcatggctgtgtgcggttgcccatgcctgtcatcccagcattttgcgcggccgaggcgggaggactgcttgagcctgggaggtcaacgccagcctaggcaacacagtaagaacctgtctctacaaaaacaaaacaaaaaaagtgtagccgggcatggcgacgagcacctgtggtcccagctactcaggaggctgacgcaggacgatcgcctgagcctggaagttggaactgcagtgagccataatcacaccactctactccagcctgggtgacagagtgagaccgcatcttaaaaaaaaaagaaaaaaaaaaggacattgtgattaatgaaaacaaacattgcctggtgataaggaaagtaagaagtaggattgttctcagattagtgacccaggagataaaggagtaacagagtgtgcaggaagcaggtctccaatttaatagcaggatggtgaagatagagcaagtgacttctttctattttttttagaaactgggtgttgctttgtcacccaggctggagtgcagtggcgtaatcatagctgactgcagccttcacctcctgggctcaagcagtcctcgtgccgcaccttcccgagtagctgagactacaggcacataccaccatacttggttaattttttgtatttttagtagacatgggggtgtggggatggtttgccgtattatccaagctggtctcagacttctggcctcaaataatcctcctgcctcggcctcccaaagtgttgggattacaggcatgagccactgtgcctggtgagtaggtagctttttgtttgtctgtttgtttgttctgtttgtttgtttttgagacagtctcgctctgtcgcccaggctggagtgcagtgatgcaatcttggctcaccccaacctccacctcccgggttcaagtgattctcgtgcctcagcctctcaagtaggtgggattacaggcacatgccaccatgcttggctattttttgtttttttagtagggacagagttttgccttgttggccaggctggtctcaaactcctgacctcaagtgatccgcctccctcggcctcccaaagagctgggattacagttgtgagccaccgtgtccagccaaacaaaaaaaagtctgtcttataaagaagatccctaatttatgatgattccatttatgatggtttgagttatggtagtttgagttaggatagttcgattgaagattttttgattttacgatggtgagaaagacacagtccgtggaacccgggcttcgagtacccatgcaactgttctgtttttaacttgcagtgcagtattcagtaaattacatgaggcattcaatacttgattgtaaactaggcttcacgttaggtgattttgcccagttgtaggctaatgtaaatgttgcgagcacgtttagggcaggctgggctaagctgtgatgttcgtaagttaggtgtattcgatgcatttttgacttaccatattttcaacttacaaagggtttatggggtgtaatgtcatcattgtaagttgaggagtgtctgtatcatagactggggggcttaaacagacatttattgctcccagttctggaggctgggagtcacagatcaaggcgtggcacattcggtgtctggtgagggcttcctggttcatagacggcgccttctcactgtgtcctcacatggtggaaagggtgagggagctctctagggtccctttaataaggacattgatcccattcatgaggctccaccctcatgacctcaacacctcccaaaggccccacctgctaacatcatcatcttggggatgaggattcaacacgggaattttgggaggatgcaagctttcaccagtagggttttctttgtaaagaaatagaaggaaatgaaaaggcaggcactgggtaggagagagctacagaagacagcggggtggtggcactccaggatagtgctgtcccccagcatcatttacaccgaagaaacctgaggcagtctttctgatgtgtcattcttaggaaaaccaccatgaatctggcatctagctatcagtgaaactgtgggagagcttaatggaagtaaagacatgtggtcccagaaatgacagatcattcggagaacctaagagaggattaaaagcaaaagggggtcatgtgcgctgtgactcaaactttgggaggtcgagtgggaagattgcttgagcccagaagtttgagaccagcctgggcaacatagggagaccctatctctacaaaaaatacaaaaattagctgagtgtggtggcacacaccttagtcccagctactcaggagtctgaggtgggaggattgcttgagcctgggagttcaaggctgcactgagctaagattgcgccactgcactccagcctgggcgacagaacaagatcctgtctcaaaaacaaaaacaaaagcaaaacaaaacaagaaaatccaaaagggaaatataagagaaaacaaaaaatctcactttgagacatcttttttgaagagttggagaggatattgtctccatccacaaaaataggatgttacaataaaagagaaagaggaaggaagagctttatatgggactgctgaaagttaaaagaaaaacattgcattaaataaattagaagggtgatctcatctgtgcctgtgacttcagttatcatcttaaggctttgggtctcaaagcacacatctagtttagacctttcttaggagccctgaagggtgcattgccaactactgcccgttggagggtccatttttcccaagatatccagcaacactcttatatgagtgtcctgctccattgtctcaaattaccataaactggggaacgcaagcaacagaaatttatgctctcccaggcctggacaccaggagtctgaaatcaaagtgcaggcaggattgtgctccctctggaggctctgggggaggaagcttcctgcctctcccggctcctgggggctccaggcatccctgggcttgtggccacagcactccagtctctgcctctgtctccacgtggccttctcatctgtgcctgtgtctcctcttctgtctcttagaagtacactggtcattggatttagggcccacccttttccagcgcgatctcatctcaagatccctagcttaatcacgtttgcaaagttccttatttccaaataagttcccattccaggttctggacatgaggatgtgaatatatctttgtggggaccacagttcagtctactagagttgtatgcagttccttctggaggctctaggggaggatcctttctgcatctcccagctcctgggggctccaggcatccctgggcttgtggctgtatcactccagtctgcctccgtctccatgtggccttctcctctgtgtctgtgtctcctcatctggctctttatttttttaaattatttatttatttatttattttttattttttttggtgacggagtttcgctcttttgcccaggctggagtgcagtggcatcatctcggctcactgtaacctctgcctcccgggttcaaatgattctcctgcctcagcctcctcagtagctgggattataggcacccgacaccacgcctggcttattttttatgtttttagtggagacgggatttcaccatgttggccaggctggtctcgaactcctgtcctcaggtgatccgcccgccttggcctcccaaagtgctgggattacaggtgtgagccaccatgctcactggccattttttattattactcttttttcctcttctgtctcttagaaggacacccgttgttggatttaggtcccaccctaaatccaggatggccttatctggagattgtttacttaatagaaactacaaagaccctattttcttttcttttttttttttttttttttgagacggagtctccctctgttgtccaggctggagtgcagtggcgcaatctcggctcactgcaagctccacctcccgggttcacgccattctcctgcctcagcctcccaagtagctgggactacaggcacccgccaccacacccggctaatttttttttgtatttttagtagagacgcggtttcacctcgttagccaggatggtctctatctcctgacctcgtgatccgtccgcctcggcctcccaaagtgctgggattacaggcgtgagccaccgcgcccggcctcaaaaaccctattttcaaataagacgccattcacaggcaccaggggttaggatgtagacatatttttggggggcaccattcaacctagtctatccctcaatctcaatacatcccctgggttaaacatgaaatgtgtccccttcttcccccaaatcaaagcaacccaaaagacccctgtgcacctgcacaccttgcctaagtcggcagcactcactgcgtagatgcccaaaccctaagctgtgatcatctccaccctccctcttgcagcctaattgagcccattctctgcccaagcaccttatgaacaggactttaaccctccatctccaccaccttcccattttcactggaaattttacttcttaaagaggccttccctgaccccttgaccaaggttagatgcatcccaatgttctcctatggatatgttgtttgaagtcctcaagtctgaacaaactcatgtgaggtcacccaagttgttagacttactgtcattaatgcttcctgccctccttccagcccgactggaactaaacaaaactaaatgagggaccaaccttgtgttgttcattgcagtttctcggaggtagacagcacctgagacccaggaaaatatcaatcatgatggaagtgatgcattcatttattatattgactccttttttttcccaaaagctattttgtgttcaaaacctggactgcataaaccacttcattgtggttatggagtgttagaagccgacacctaatcaaagaattcagtgtgtctcagtggtaggaactctaaagccatctaacattaaatgcaataaaagttcagttgcttacgacctggcgccgtggctcacgcctgtaatcccagcactttgggaggctgaggcgggtggaccacgaggtcaggagattgagaccatcctggctaacgtggtgaaactctgtctctactagaaatacaaaaaattagccaggcgtggtggtgggtgcctgtagtcccagctactcaggaggctgaggcaggagaatggcgtgaacctgggagacggagcttgcagtgagctgagatcgcgccactgcactccagcctgggtgacagagcgagactccgtctcaaaaaaaaaaaaaaaaaagttcagttgcttactctccatagcctcaattcaaatcctcagtagccacttgtgagcttgtggctaccattttggacagtgcagatagagaacattcctatcattgcaggcgatactacgggcagtgcttgctccaaaacagggggtctcaactgggggccggccttcccccacagggcacttgacagtgtctggggacagttgtggttgtcactactgggggtggatgctgatggcgtgtggtgagtggagcccagggacgccgctctgcaggtttgcagtgcacaggatggccctacagagaatcatccagcctcaaatgtcggcagtgctaggctgagagaacctgctttagcgtgagagtcagtctctctctttctgtctctctctctctctccccctctctcccctccccactctcgctctccctccctcccccctccacccatcccatctgttatctacctacctacctacctatcaattatctaaccatcctaattatctatgtatcacctatctatcctatctgttacctatctacctacccacctacccatccatccatccatccaatcaattaatcagtgtatcatctttctctttccatgtatgtatcatacccattgtccatccatccatccatccatccagtcagtcattcaatcaatcaatcaatcatctttctatctatccatctatctgtctatcatacccatctacctatctttctatctgtctgtggcagagattctctgccaatggcaattcagctccatcagggagatacttcttccctggacaagtctggagacatttttgttgtcacagctcaggtaggtgctactgataacaggtgggtggagtccagggtcactgcttgccaccttacagtgcacaggatggccccaccacagagaatcatccagctccaaatgttaatggactcagtttgagaagctgatctcaagggtaattcgggggagtcctgcgggattgttgcatcctattgaaggggaaattaatgaattttgtaagtgtaatggggcggggggactgggttaagagagaatactaactgcttatccctcctctatgcccagagaggcttatctgtgttccatcgttttacattccttgaggcacggcgagttcttgcttccctccctagtgcagctgtaaagtcacaaggttgacaagcaattgctgcaaaagtatgtattcccaagaatgtaagacgtacggtgtaacaaatgcaaaagagtaattaactgcctttgttctcgcttctgcaagtatgctttctgcagcacgtaactcccgccacaaactgcttaaaaggtgattgatccctctgtacggggctcagactttctagaccctagtccgactgagctggtgatcaccttaataattataattataatggtcatctcctaactgtgctcggtctctaccgtctctgatttatcccgcaacactatcgtggaggtaggctaggatgtatctttaacctggctggattgtattgtagatgtgtgaaaaccagcccttgtttttcttggtagagttgcactcaaatgttattgaaagctgcacatactgtgcttgtataaatacactgagccagaaatcacgaacctttccctggcttcacatctgttagtgttgtgggagaagatgagaatttcttgtttttcttttcacttctgtgattatacattttgtattttgttgttgttttttgggacagggtctcgctctgtcacctaggctggagtgcagtggtgtgatcatagctcactgcaacccccgcccccaggctcaagtgatcctcctgcctcagcctcccaagtagctgggactatagtcgcatgccaccatgcctggctgttttttgtgtttttagtagagatggggttttgctttgttgtctagcctggtcttgaactcctgtgctcaagtgatccgcccaccttggcttcccaactgtggggattacaggtgtgagccactactcacggccacattttgtatttctgatgagaaagtgtaatttaatacactgtacatcggagagtgtagttctgaaacatctgcatcttttaaattaggacagtgtaaaaatggaatgttgtttgactcagcaaaattttgagggagtttgtttccaactgtctagaccagtgaactcaccaaactatctaccacacactgcttggctgaattggctctactgtttttaactgaagtttgaagtaaatattccaagcttaaaaatatatcttgttcctcccccacccactggttatagcagcaatataaataaaaaataccttcccaagaatatccaaagcatacattcttttctaaagtaaacattgtttatagagatacaatttctataccataagattcaccctttaaaaacacatagttctttagttttcagtttattcacagagtaagcacactgttttttgtttgttttgtttttttcgagacagagtcttgctctgtcacgcaggctggagtgcagtggtgccatctcggctcactgcaagctctgcctcccgggttcacgccatcctcctgccccagcctcccgagtagctgggactacaggcttccgccaccacactcggctaattttttgtatttttagtggagacagggtttcaccgtgttagccaggatggtctcgatctcctgaccttgtgatccgcccgccttggcctcccaaagtgttgggattacaggtgtgagccaccgcgcccagcccattcattcattttttgagacagagtcttgctctctcacccaagttagagcacaggggtgcgatcactactcactgctgtcttgaactcctgggctcaagtgatcctcctgcctcagcttcccaggtaacttggactgcaggtgtgtaaccaccacgccctgctaattttttgatcttttaatagagacggggtctcgttatgttacccaggctggtctaggactcctgaactgatgtccttccgtggcctcccaaagttctgggattataggcacgagccaccatgcctggcaacacacactcttttttaaaaatactttttaacagctttttttcctgtctataaaatagaaggtcattatacttgtttgcagcagtaattccaaaaatcgacttcgtaaagaagaactgcgtgtttcacacacttatttcctccatggtagcatttaatgttcttttattgattttacccaggggggaaaatgtcaaggaaaagaactgagtttgaggatgataaatgtgtacgttctgatatcattattttgaaacaattatttaatgcaatgcgtcggtttcacttatcaatttaacataaattgaacctatgttgatgaactatttctatagtcataaattttaaaaggtgagaaagttatatagtgaaatgcatctgtttttgtgcctcacctgtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaattttttttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgcagtggtgtgatcttggctcactgcagcctccgcttcccaggtttaagcaattctcctgcctcagcctcctgagtagctggggttacaggtgcctgccaccatgcccggctaatcgttgtatttttagtagagatggggtttcaccatgttggctgggctggtctcgaactcttggcctcagatcatccacctgcctcggcctcccaaagtgctgggattacaggcgtgagccagcgcgcccagctgggttttaccttttttgtttgtttgttttttgagacagagtcttgctctgtcgcccaggctggagtgcagtggtgtgatcttgcctcattgtagtctctgcctcctgggttcaagcaattctcctgcctcagcctcccaagtagctgggattacaggcatgtgctgtcacgcccagccaattttttgtatttttagtagagatggggttttcccatgttggccaggatggggttttaccttttttgaagtgtattttccatgtagccacctctcttggagtgtccatgaggaacacgatgctgtccttggtgtctcagcggagccactgtgacgctctcctcttgcaaagatttctggtcatgatgtctcaacattggcctgtttggggttttttttctcctgcattttagggagaattagggctcatccaccctcaccttctctcccccattgaattggtgcatcctgtttttttttagcccctgggatgcccatgttcaagattccttaagcatcacagtttaaggaaagaaatgcagattatttaaaatatgtggggtgagtgtgcagggtggtgatggacaatgcatgtgtttaattcagggactgttgtgccagctgtgtttgagccttaggaattcttatagttgactggcatttacagtttattaaggcacttacctcttaggtgtataatcctcaaaacatctaaaaaattagtgatttttgttatccaagttactttgacatcagccatttgctgtctcacccacatgatttctcattatgttaccttattattggctaagttaatctgcttactgaggacctgcatgtgacttttcccattaaaagtaagttaagtctgggcgcagtggctcatgcctgtaattctagcactttgggaggctgaggtgggaggatcccttgactttgagaccagcctgggtgaaaaagtgagatctcaaaaacaaaattagccagacatggtggcgcatgcctgtagtaccagctacttgggaggctgaggtgggctgatggcttgagcccaggagtttatgctgcagtgagccgagattgcatcactgcactctagcctgtggcacagagtgagacctgtctcttaaaaaaaattaattaattaattaaaaataaataaaagtaagtccaagtggagatggttggtggtgttggttggataacattgtgaatgtatttaacaccgttaatctgtacacttcaaaatggttaattaagatggtaaattttatgttgtgcgtattttaccataattaaaaaatagatttggtctgcgtgatggctcacgcctgtgatcccagcactttgggaggcgaggtgggcggatcacctgaggtcaggagttggagaccagcctggccaacatggtgaaaccccgtgtctactaaaactacaagaattagtcgggcgtagtggcaggcacctgtaatcccagctactctggaggctgaggcagaaaaatcgcttgaacccaggaggtggaggttgcagtgagctgagatcgcgccactgaactccagcctgggtgacagaatgagactctgtctcaaaaaaaaaaaaagatttaaaacaaagtaactatgttcaaggccaggtgtagtggctcacgcttgcaattctgacactttggggcgctgaggtggaagattgcttgaagccaggagttcaagaccagcctgggcaacagagtgagaccccatgtccaaaaaaaaaaaaaaaatcatcagctttcattctgggatcgtaagtagagacattgtttcccagacctggtacagatggaacctgcctacgtgtcttcaatgggcatcttaagacttatgttttggacatatcagacttttggaataaaggagctgagttgggagtacaaactcctcttcttatccatttccctgtggcaggagattttgctctcagcccccacttactggtgtgagatccttgattctggaaggtgagctgtgctgttcagcccacaggtcctcatgaatgtctacattcagtgccacgcagaataagaagaaacacacaccagctctgcttctgtgaagcttactttttgttgttgttgttgagagggggtcttgctctgtctcccaggctggagtgcagtggtgcagtcatggcactcattgcagcctctacctcctgggctcaagagatcctccctgctcagcctcctgcgtaactgggaccacagatgtgcgccaccatgcccagctaatttttaaattttttgtagagacagggtttcaccatgttgcctgggctggtcttggacgcctgggctccagtgatccacctgccttggccttccaaagtgctgggattacagacatgcgccaccgagcctggttttgcttactttttctttttttttttaaattcctcttagcctatcttgggggaggcgggtcagtgttattccggtgtacatacaacaaaatcacccatttgaagtgcacactgggaggagtccttgccaaatggatagggctgggtaaccactgccacatgggacatttgggaagccgatgtttgaatgttttcacgcttacagatgcattcatttactacgtttattattctgtgtgatgtgctttctgtgtgttatttcacttaaacccagtgggggtaaagattatgatccctatttggtagatgaattttagagaggttagggggcttgtcaaggtcacacagcttttaaccgtgatgggatgacgcctcttgaatgaggcttagtagtgagatggctgaggaaggaaaaaagtaggaaggagagaaagagagaaggagggaaggaagaaagtagggagaaaggaaggaaaggagagggaaggaagggagaaaggaggatggaaagatggaatgagaggaaagaaggaaggaaaccgatgaaagaaggagggaagggctgaaggaaggaacaggtgccctgttcaggtgggtttatcctcaggaaggacccaagatggaaagtgtgtatgcaagaattattttaggccaggcgttgtggctcatgcgtgtaatcccagcactttgagaggctgaggcaggcgaatcacttgaggtcaggagtttgagaccagcctggccaacatggttaaaccccatctctactaaaaatacaaaaattagctggctgtggtggcacatgcctgtaatcccagctacttgggaggctgaggccggaggatcgcttgaacccaggaggtggaggttgcagtgagctgtgatcgtgccactacactccagtctgggccacagagcaggactctatctcacaaagtagaaataaataaaaaataaataaaaacagagatgaggacacagacgcacatagaggacgaccctgtgaggacacagggagaagatggcatcgacaagcctaggagagaggcctcaggaggaaccagccctgcccacacctgggtctccgacttccagcctccaggactgtgagagaagaaagttctctttaagtcctccagtctgtgttaggttattacagtagttcgagcaaagtactttatttacatagaagtctgccacaattatgagccctgaaaccctttcccaggatgaaccgaggtcagagtgtaattaataggtactttttttcatttacgtttagccactagattttttttttcaacagagagtagcgaatactgcagaagctgaatgagatgaagcttaagtcagatctttatgcacctcagaatatttgtactgatgaaaagaaataaccaacacttgatagagggaaagattgagacccagaaagtaatctctccctgtgaccactcctaccaaattcttgcttaactaccttattttgttcgtttgtttgtttttgtttttttgagacggagtctcgctctgttgcccaggctggagtgcagtggcgcaatcttggctcactgtaacctccacctcccgggttcaagcgattctcctgtctcagcctcctgagtagctgggattacaggagcgcgccactaccacccggctaatttttgtatttttagtagagacggggtttcaccatgttggtcaggctgatcttgaactcctgaccttgtgatccacctgccttggcctcccgaagtgctgggattacaggtgtgagccactgtgcctggccaactaccttgttttttttggatgaaaatgtggttcttacctcagtaaagattatgaagggatttatgtacagatgactaaaatatcagccattagtttcctatttgtttttgttgttgtcattttttgttttgagacagggtcttgctctgttgcccaggctggagtgcagtgatgcgatcttagctcactgcagcctcgacctcccaggctcaggcaatcctcccacctcagcctcccaagtagttgggacgacggctgtgcaccaccacacctgggtaattttttatttttatttttgtagctgggatctcgctatgttgcccaggcaggtcttgaactcccggcctcaagtgatcccaccatctaggcctcccaaagtgctggacttacaagcgtgagccaccctgcccagcctagtttacaatttgaacttggtttttcatctcggctcctttgaagacttctgtcttctcccatgtttggggcagctgtgtgttgtggacattccttagtgatcggcctgggaaggctcagacatgtctaggctgcctttgtaggaatagggattagtagctccttagccccactctttcctgggatgttgctgtttgctgaggtctgcacagttcagaccaccctggaagcctctctcaggttctcagagatggtggagttatacctttgaccgtgagctcgcagcattgctagggaatgtacttggctaaatttggaactatttggttgaatttgtaccccttgggcatatttgctttggtaacataccacagactgggtgccttaaaataacagaagttaattgtttcacagtcctggagaccacaactctgaagtgcagatgcggcagggctgtgctccctctgcgggctctaggggaggctccttcctgcctctcccagctcctgggggctccaggcgtccctgagcttgtggccgcatcactgcggtctctgcctccgtctccacatggccttctcctctgtgtctgtgtcttctcttcttctcttacaggaacacccgtcattgtgtttagggtccactccaattttggatgacctcaccttgagatctttaacttaattacatctgcaaagacccttttcccaaatgaggtctcatttacaggttctgtgggtcaggacatggacatatctttctgggagaccatagttcagtccactacagttgtatccagttgtttctggaggctccaggggaagctccttcctgcctctcccagctgctgggggctccaagtgtccctgggcttgtggccgcatcactgtactctctgcctctttctccacgtggccttcccctctgcgtctgtgtctccttattagttcaccactcatattgcaccaccttcaggatgacctcaccttaatatatacctttttttttatttcattttttaaaaaagtggagctgaggtcttgctgtgttgcccaggctggtctcaaactcctgtgctgggattacaggggtgagccactgtgcccagcctttgtgtatatcttaatcacatctgcaaagaccctgtttgcaactaaggtcccattcacaggtaccaaggattaggatgtcaacgtatcttttccagggcaccccattcaatgcacacaaagtggggagaggggagattggctgtgtttaggtgacctgtgaaaggccgagctagctgtgcggcgttgctcttgcagcacagaggaagaactgggctcagatggtgtcagctgttggtgtctgagatcatccgtgaatctactcccgggaatgtgctgcagtgagacacggtccttctcccgtcaccttcctgaccccatcccatatacccacggaccccaagggaaagtactcagggttggttggtttcttttccgttttgtgaccgcgtgaaattccatgtcacggtccctgtgtttattccatacagctctcctgaagtgttttgagttctagcaaaatttaaaaatataaccaaagaaacttaaatccgtgtttctcctctttctggacacttctttagtatgaatgggcatcgtgatgataaacacggtggcctgctgtctttgcttctctctctgctggccgcctccttccttccctccaaagtcacaggcaagagggatttagggtttgctgggcttgaggaagagaggaaaaggccatctcttttcacagtgagaaatgtgttttctgttctttctcatacctcgctttgtacatttaaaaaaattatttctctttagatttttgaaccaagagagatatatttattatttaaaaaaaatttttttttgagacaaaatctccctctgttgcccaggctgcagtgcagtggtgcaatctcagctctctgcaacctcctgctccctggttcaagacattctcatgcctttggagtagctgggattacaggtacccgccaccatgcctggctaatttttttgtatttttagtagaggctggggtctcactgtgttgtccaggctgatctcaaactcctgggctcaagcgatcctcccatgttggcctcccaaagcactgggattacaggtgtgagctactgtgcccggcctatttcttttctaaatagaggcagggtctcactatgttgccctggctggtctcaacctcctgggctcaagcaatcctcctgcttcggcctcttgagcagttgggactccaggtgcacacaaccatgcctggctaatttttgtattttttcgtagagatagggatctcaccatgttgcccaggctggtcgggaattcctgggctcaagcagtcctctgacctcagccttccagtgtgctgggattacaggtgtgcaccactgtgcctggccttatttattttttatttatttatttttggagacagggtttcattctgttgcccagactgcagtgcggtggcaaccatagctcactgcagcctccacctcctgggctcaagtgatcctcccacttcagcctccccagtagctgggactgcaggagtgcatcatgactcctggctaatttcttttaatagggatgagatctctatgtttttgtagacaaggggctctcgctgtgttgcccaagctggtcgagaactcctggcctgaagccatcctcttgccttggcctcccaaagtgctgggattacagttgcgagctacggtgcctggctgtagattccccccagcccccaagccgccagttgtgagtcttcactaacaagggaacctttcagcattttccatggtcatggtgattcacctaatattttagttctgctgagttgtctaaacattcgggataaaggctgtcattttttggtgaccgtaatgtgtatgtgtatgtttacagttacacatgcctgtatttgggtggagctcagaagatgcccatggcatttttctgggaaagttgaagtttatgatgtttgctctttattgggagtgtggaggtcgtctttctccttcttcccatccctccagacagaaagctgggatgtggccaggtgcagtggctcatgcctgtactcctagcactttgggaggccgaggtgggtggatcacttgaggtcaggagtttgagaccagcctggccaacatggtgaaaccctgtcactactaaaaatacaaaaattagccaggcggggtggcgggcaccggtaatcccagctactttggaggctgaggcaggagaatcgcttgaacccaggaggcagaggttgcagtgaactgagattgcgccattgcactccagcctgggcgacagagtgagactctgtaacaacaacaacaacaacaacaacaacaacaacaggccaggatgtgtttgtgtgtgagttggacccaagggcttgggaaggatggatagggtaggggaggagggatagatggatgagggaatgcagagagagtggccacactgtcagaggctttcaaaaagcaggaggttctccagtgggagagaggagacctgagtccaccccgcattaatgtttacagatcagaattgcacacatagaatggctcataaatctgatccaccttcctcgtctggcacttggctggagaaacaactctttgaatgttggaggaaaagcccactgtattgcacctgctataaaaagggcgtgcccaccttaaaagtagccacaccttcccgagattgccatggtccttctaagtctctgaaatgtatagatcaggtatatttgggaatttggggatttttctaaatttgggatgagaatgggtgcatgtcctttttaattatacaacaccctcagcagagtctgggctggatgttgttatcaagacaagaatatttctgtagtgaaataggtagatattcaccccaaggaggatcaagcctgaacagtctcacgttaggcaaggtccagttttgcggccaggtgtgttgatgaagacactttgagtattcagagcctttagctttagccactgtgggtaagggattgtagaacccatacttaagctttccccttaaagctttgactttaatctccacattgcagccctgcaaaagaacagaatcgtgtcctttgcagcaaagtggatgcagctggaggctgctatcctaaacaaattcatgcaaaaaatcgagagccagatattgcatgttctcacttataagtgggatctaaacactgagtacttcatggacacaaagatgggaacaataaacactggggattccaaaaagaggaagggagggagtggggaaaagactgaaaaacttcctattagaaactgtttactacttgggcaacgggatcattagaagccgaaacctcagcatcatgcaatatacccatgtaatgaacctgcacatggaccccctgaatctaaaattaaaagaaaagacataaactccacatctgatttccctcgtgcataacactactacttagcttggagagagatggaggggatctctagggtggggaatggaccacttaccttcaagatctcccttatcaggaaggaaagagctgacctgcctagaaacacttgaaaacactctttttttatgtcttattgggcaaagctgggtcagatggccacccttagctgcagagaaggctacaaatagacattttctcctcaagtgggataatgataactggggaatgtgtactggagagccttccaacaccaagcggggaagatctaccagcaccattaaatgttgcctttgtcttctgtgcacttaagctgataaaccttaaacattacagcatgccacttctgtctgctttgaataaggttgtttaccgacatacttctgcagtctgattgtggcgttggcgggactgacaatatctcccagggtagcgcaaagatccgctgcagtgcataagtaacgtgttttgagttttgtatgtttataatgcacacagctcagagaaagctttaaagaagtcacagaagtgtaaaaaatctgttgagtcatagctgttgttcttaaagtaggcatggagaattctctctgttgagggtcaaatacaagtactaagacagaatgttatgcagtaaacacagccaagtaatgaatgggttccttggggtgggtgatagagaaagataaataaggaggaaggaaccagatagaggaagaaaagtcaaggaccatattcattgcattattagaattttagggtgtggcaagaatttaatgtttcctaataatatgcaagttctgttggaaagaagagcaacaggagactaaaaggttaaaaggttactctgttgcccatttcataggtccaatggcaggataagcttgggttggatgccagtgttcctgattcctaattgtgttttatccaattgaaacatcagtggccatagtcaaacacctaaactgtatcagttcacagtcctcaaagcccttctcccacttcctgtctttgacctgattccacctaattttgtccacaccatgttgtactgtaataaaacctattttatttccaaattaactaagagaatatactttaaaaatgtgttactatttcattatttgtttactttttttaaagaaatatttaacacctgtcagctattgacattgtttccttcttacactttttctttatcttgtagttcactttctatttctgccataataaaatattcagtatcggaaacttcacttaaaaagcaaaggttacttctcctcctcccttcccagtctgccctataagctagtaaattcatcattcattagcttagatattttacaacatggggattttagtttacagcaaatactctaagtaaaattggtagcttaagtacaactttttcttttcacgttaccatgtgcaatcaatggcattccagactcttggaaggaaatccattgtatggttgtggtctttttttttccttctcaaaccagtcaaaaatacccagtcacaatttaaaaaattatccgcccttggtggtgcacgcctgtagtcccaactatttgggctgaggtgggagggtcacttgagcctggcaggtcaaggctgcagtgagctattgattgtgccattgcacttcagcctgggcaacagagagagaccctgtctcaaaaaaaaaaaaaaaaaaagacaaaacaatataatgtgatctaccctctaagcaaattttcatatatacaattttactattgtatatgtgagctatttatatataaaatttcatttatcagttcagtattgttaactatatgaactaggtgtatggtagatctccatggtttatcttgttcaactaaaactttgtatcctttgaccaatatatttccccttccccctcaagccctaccctctgataactacctctctactctctgcttctatgagtttgactattgtagattctgcattagtccattctcatgctgttaatgaagacatacctgagactggttaatttataaaggaaagaggtttaatggactcacagttccacatggctgcggaggttccgacagtcatggcagaaggtaaaaggaggagcaaagtcacgtcttacatgacagcaggcaagaagagagcccgagcagggaaactcccatttattaaaacatctgatctcgtgagacttattcactatcaggaggacagcatgggaaaacccacccccatgattcagttacctcccacctggtctctcccacaacacgtggggattatgggagccacacttcaagattagacttgggtggggacacagccaagccatgtcagattccttgtataagtgagatcatgcaatatttaatatttgtttttctgtgcctatcttatttcactgaacataatggcctccagttccatccatgttgctgcaaatgccagagtttccttcttttttagggctgaatggtattccatcgtgtatatgtaccatgttttctttatccatttgcccttggacggacactgaggttgtttccacgccttggctgttgtgaatagtgctgtcataaacatgggagtgcaggtgtctggaagatcctggttctcttgggttttgcaatctagcataaagcaggcacaggagtaccagccaatgaatggataggtaaatggatcaatattgatcggtgagatttgctcgtcaacagatgttggttcctcagaaggatacacttccaaaccatcctttctctgaatgtcagtttctgagaagcctctctgctgtttggggtgggtgtgatcacataatacgggagggcagttttgttttagttgctcatctctgtctgcagctgtgaatgcgttgtttaaaaatattgctgaggaatgacttgcatgtcagtaaggggctgctgacgctgggatcaaggtacgtcaaaggcaatttagggatactctagaaatcctgcatcagttgcagtggctcatgcctgtagtcccagcactttgggaggccgaagcaggaggatcacttgagcccaggagttcaaggctagcctgagcaacgcagtgtgaccccctctttacaaaaagtacaaaaattaactgggtaggctgaggcgggaagattgcttgagcccaggaggtagaggctacagtgagctgtgatggcgccactgcactattcgttccattaacccaagaacatttatgctacgtgaagaatatttcaatatgtgcgtgaacacgtgcacaccttgtaggatcagtgtgttacaggaagaggaggaggatgaagaggaagaagaggagagggaggaggagaaaggaggaggaggaacaagcaaagcttgtttagagattttgattttcttttatatctcattgactattagatttcttcatttacatgcaccccagtgggaggaagaggagggagaggaggaggagatggaggaggaggaagaagtggaaaagaaaaggatgtagaggagaaggaagagatgaaagagaaggaggagaagattgaggaagagaaaaaagagaaggaagagatggaggaggggaaggaggagaagagagtgtttggattgaaaatgtcccagcagaatacagtagagctattggttttcttttatatttgtagtggttgcagttgttgttgttgttttgttttctgtttgtgggcacctatatagcacttcatcccaacccacgccagattgtagaatacggactccgtactttgagcaagccttaatgtgcgttaaggaaacagccgtgttgaggagggctgtgtgttttacaccctgtctgtatttctgataaaaccagagagcctgaagagaaaaaggcatgttatataaatacatttactattactctaatgcttctccatgtgggtgtgtggggcgtgtgggtgtgctgtgtgcgaagactgatctgcagaaattatggccagtttgtccccaaattgaggaaccattcagaggcagatggctctctctgtctccctctctctccctctttctctctctgcaatttctgtattcagtggaaaattccaggtgagcgcctctcactaaatgccatcagcccacgtgcaccatgacacaaagtctctgaaagtttcacttggggtctgtgtttgccgtcctggtgcagccccccgctgattgcatggctgtggtggtttcttcctttgtcggaagacttaatgacctctgtcgatttcttctctctccaggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgtgagtcccctcctgaagcctctccccacgcactctccctagacccctgtgtgtctcttcttataagaagctgggtgggccgagaccatggcctgcgtgcaaagccttaggccacagcagtctccacctgtcaggtcttatcagcctctgatcttagagctggaatacctccagggctcctgacctccatggctgaccaggtccaaaaagaaacgctctgtgttcagaagtccgtgcccaaggccccttgctcctctcctgggtgaaccaagtatctctgcccggaaaaggatgcagaaatctttgtctcctcacctccttgggttctgcatctatagctctcggcagaactggttaagttggtttttaagggaccacagtcacgtggacggggctgggcttcaggtttcgttgggtttctggttgactgtggatgagagataccccgttgagatgcagcccacacacttccagctgatggtacacaacagtcttatgtcctagggtaggtgtgatagtccattcaggctgctataacaaaggatcttagactcggtaatttacaaatgacagacatttgcctcatggttctggaggctggaaagtccaagatcaagacacggtggattcagtgtctggcgaggacccgcttcctggttcatagatggcgccttttcactgtgtcctcacatggtggaaggggtgagggatctctctggggtcccttttataagggcactcgtcccattcatgagacttcaccctcatgacctcccaaaggacacaacacctaacaccatcaccttgggggtgaggatccaacatagggatttgggaggacacaagatattcagaccattccagcagggtaattccatttccacccagatgccttagacaaggatgtcctgcgtgtctctcctttccctccatgggtgccttccatccaattcccacgtcttccctccgccatcttgctaccatgcctctcctgtccacctatccatcttctgctttatctgggtcccgtctctctgccctgattttctgtactggcttccctcctacctggtctttctctcccagccttgctccccttgaagacattcctcactttatagcctcactggtcctcccaggtacctctgcaatgacctgcctctctcctttcatcctcagggtactcctgaagtatcccatataaagccccagcaatgcagcatcctcctaccagtatcctcgtggactggccccctgccaccacctccctacaggagaaggtagaaggtgctgttcacacactcattccggggcttctcccaggccacccttctttgacaggcctccttctttgctctcatcattgtccttcacttcccccatctaagaaacacctacctgttttccctcattcacctgctgtccccgggacacagggtgcctcccatcatgttcttgaagcacctcgtgtgtactggaacaagtgcacctgccttctcctctagacccaatgctgcctaagctccgaacaaaatcatatgcagaggatgggcgcggtggctcccttcctcccttcctttcttcctttctgcatttctctttctttcttgacagggtctcactccttcttgcccaggctggaattcagtggcacaatcatggcccactgcagcctctgccgcctcccaactagttgagactacaggtatatgccaccatgcctgaccaacttttaaaagtttttgtaggatgaagtcttgctgtgttgcccaggctggtctcaaactcctggcctgaagcagtcctccagcctcagcctcccaaagtgctgggattgcaggtgtcagcccctgcacctggactgagaatgcatgtctgttgtctgccgcgtccctccaccccaacccccagtttgtggtactttgttaatgatagccctgaggaactcacacacaccccctgcgcctcctggagcaggagagcagccgagacgatgggctcctgagtactctacagttcagaaatctaaaatcccacagaagaaccgcatggacatgggagtgggtggagtatacaagtgagagaattccccaggatggaattcttgagctcccgcaagttaaaaaatagggaggagcttgtagaacagagctttagttaggtagttctcctttcttcaaggcaggatagctcaagactgttttccttggcagataaggtgcattcctgcagggacgtggattctgattttgatattccctgctttcaattaaggaacaaagtcgtttatatttcttaagtcttatataaagccctagagactttagaaattctattcaaagttacctatgttggtttatttttatcttttatataaaaaagtatatatatagatttacatttagagacgggttttgctctgtggcccatcttggagtgcaacggtgcaatcacagctcactgcggccccaacctcccgggcttaagccatcctccttcctcagcctccagagtagccgggactacaggcacccatcactacaccctgctaatgtttttatttatttttaatttttaaaaaacatatgtatatatttttcacaacctctttggtgaagataatgtttttgttttttctctatgaacagggtcttgctatgttgcccaggctggtcttgaactttaggctgcaagcaatccacttgccttggcctcctgacatgctgggattacaggtgtgcaccaccacacctacctcattttaaaattttctgtagagatgggatcttactttgctgcccaggctagtctcaaactcctgggctcaaatgatcttcccacctcggcctcccaacatgctgagattatagatgtgagccaccgtgcctggcctatttctaacttttaaggagtgaaatttctctgcaccgtgacagcttttgaagaggacattttggatgcttcatgggttgtcctttgcccgtacagctcaccggctcctccgagtgctggttacagtcgaatgtgagctgttatttgtatgtcaggtccgcctggtggtgttgccaaaaagcatgaatttttcctcatcatttaaagtctacatggaatttaaggccactttcgatattattcttgggaggattttattcagtgttttgggagaacatggcaggggctcatttcagaattctctgatttggggccgagctcggtggctcacacctgtaatccctgcatttttggaggccaaggcggaaggatcacttgagaccaggagttccagaccagcctgggcaacatagtgagatctcgtctcttaagaaaaaaaattaaaaagaaaattctagcctggccaatatggggaaaccctgtctctactaaaaatacaaaaattagctgggcgtggtggcgcacgtctataacccagctacttgggaggctggggcactagaatctcttgagcctgggaggcagagcttgcagtgagccaagatcgtgccactgcactgcagcctgggtgacagagcaagactttgtctcaaaaaataataataaataaaaataaataaataaatacagttctttgattttgaaatagtgcagaaaacaaggcaggccctgaagtccacagctctcatgaaaagttttggatctagggaagtgattgtcaacaatgagcctttaaagacttaatggtgatagcaatttacaggtgacttttcccaaaaaatgacagaaaatgagtttgccacttgggcatgttgactcacacttataatcccagcattttaggaagctgaggtgggagtgtcccttgcacccaggagtttgagaccagcctgggcaacatggcaagaccctgtctctacaaaaagtacaaaaattagctgggtgtggtgggggggcctgtagtccctgctactcaggaggctgaggtagggggatcgcttgatcctgggaggcggagattgcagtgagccgagattgtgccactgcactccagcctgggggacagagcaagaccctgtctcaaaaaagaatccgaaaaacaatgtagacttggagggggtgatgtaacttagcccatgagaccgccttagtgacttgctgataattgatctttcggtgccctgcagtattatgataacctgctatagcattttgctttttctgtgcattaacactttagggaccaagtggctttaagaactggattaaagttgatccagtgcattcagacacttggcattccctgtacataacacgagagagcacgccgggtctggccagccccatggataagatgctggagggtgtccaacgttgcatgctgaggagcatgtcttagaggagaatcctagatcctctgtgaagaatgaatttcatcctcccagctgtgcagcttctcttctaaatgtaagttgccttgctcaacatctgcttcccatacgggcagttttaggccttggacttcttgatgaaggtataaaacgaggactttcagcggaggtgcctcccatttatggctggaggagtctctggggtggggccgtcctgcacacttcagggtgttggggagtgtccctgggctccacccaccagcggccaggagcagcaacctcagttatgaaaagcagaaatgtctccatacataaccaagtgttccttcagggagggagggcaaagttttctccactagtgaaccactgtgatagacagacgacggacagagagagatgatagatacgataggtaggtatatgttgagatggataggtgatagataatagatattaagataggtgtaaatgatgggtgattgataggtgagtagatagatgatgggtagctaatagatgatattaagataggtgatagataatagatactaatatatacagctatagatgatagatgatattgaggtgggtaggtgattgattgatagattaatgaccgattgcatgtaggcagagctctcatgctaaaagagagtttctcaacctcagcagtgctgacacatggggcgggatcatggaggactctgtggtggggcatcctgtgcactgtagggtgttgagcagcgtccctggactccacccagcagatgccaagagcacccatcccatctatgacgagtatctaaagatgtctctagatactgctaagttccccctatggggggacaaaaagttatccccagttgtgaaccactgtgacagatagttgatggatggatggatggatggatggatggatggatggatggatggagatcaacattgagacagatatttgatagatgacagatattgaggtagatgatagctatagatgatagatggttgatagatattagataagtgattgatagatgatagctatagatgatagctgattgatagatagctggtagctatagatggtagatggttgatagatattgagatagataggtgattgattgatagattgatgatggaacgtattagtagagtttctcaacctcagcactgctgacatttggggctggaggattctctgcggtggaaccgccctgtgcactgtagggtgctgagcaatgtctctgggctccacccaccagatgcctctagcacccccactccagcgtgacagccaaagatgtctccagacattgtccagtgtttattgtggggagcagaatcagctccattgacacccactgtagcggatgcacagacagataaatacctgtgcgtgtggagtccctttctcccttttctgccccagcccctgagcctgcagccccactcttctgtcatgattgattggcttatgggccaaacagtggttccagtgccatattatctatggcacagcagccgagccaagccagtgggtttggtctgtggttgcagggcttagccagctttcttctacagaacttggaaggcaagaggtctctccactccgggccacatccttctagttcctggatgaccgctcgtttctccatggagaggagttcatgccagaacctcttcttcggggagagtggatgcatctcttggaaacatctttttttaaagtctgcagacttgagtgtggtccccattgtcattggtacttgttgggggtaggagtaaaatcattcctttgttttactgagagttcaggaagaaagaacaccatgttctctccttttatttatttatttattttgctctctatttgaattttaaaggcaaaaatctagaaatagcgcttcttgctctgtcatcactgcctgcaaagcacagagaccagagtgaaggcaggcagctcctgggtcttctcttcctcttctttgtccaaaaaatgatacattgcatgtttagtatttggggcaaagcagacgcttcaaaaagggaggcttattttattatctatatttttcttttttattattttttaccttgattccctttttctatgtatgaaaagggaggtttaagttcttgcaagagaatgcaactgtagtgtcttctgaatggagttttccatttgatgccaagccttccagtgccttggtctaaggagaactgcgtagggtgagaagagtcccagcgatacgtggaaaaggggccttaccagctctggagggcaagaggtagggggtgaagacgcagtggacacctaaggagaattttgcaggaggagtaggggtttattggctgaaaggggtgggtggtggaaactcattctagacagggagtgacacggaagccatgggtcactacggggcaggagggacatgggggagaaactcaaatctgagttcagccaggaggtggacacaggaatgcagtgaacccagatgtgtaggagactgccatggggactggggtatgaggaaggactggctctggctcggctgtgcatataaggaaggactggctctggctcagctgtgcatttgggctgctggacagtgaggagatccagggagagagagtgcattccaatttgggaaactttgagggcaaaacatctgcagcaactgtctcagaagagagcctgaggcagggtccttggagggaggaagccacaggtggatggagccaccgagggctgctaggtcaccttggttaagggctagttgcagtgcagccaggtcggaaagtagagccgttctggagcctcacgtggcatagatgttggaggagatgggatgaggatggctcattttcttcttctcaccacaaaagcccagctttatggcgggctctggagagaggaggaccaacttctacggtaaggcgtctccaaattagtgaggctgatttgcctgttcataaaaacaaaaacaaaagcaaaaaaatcccttagaggacaagccatccccgcagaccctgcaaataaaagactgcagatcagcttcgcggatggaaaagtgctgctgtcagctaaagatgaggacagagctgctcagctgaggtcactggagaggatggggaggggacttggaaacctcccttgtctcagtcgttgttgacgacattgactctttcttcatgttgactttccccccgttcatagattcatagattgctctctatgctggaaaacattctttaaaatttaatttttttattttgttaacatatatcacataacagtttactattttaacttcctttttttttttttttttttttaaaagaaatgaggtcttgctctgttgcccaggctgcagtgtactggtgcaatcatggcccactgcagcctcaacctcctgggctcaggtgatcctcctgcctcagcctcccaagtagctgggactacaggtgcgcactaccacgcctggctaattttttaatttttggtagagacagggtctcgctgtgttgcacaggctgatctccaactaccaggctcaagcagtcctcctacctcaggctctcaagttgagctgggactataggcacatgccaccatgcccagttaatattttaatttttggcaaacatgtgatcttgctttgttgcccaggctgttctcaaactcctgatctcactcaatcctcctgccttggcctctcaaagtgctgagattacaggcatgagcgtccatgcccggcctcattttaaccatttttaaaatgtacagttcacggctgggcgtggtggctcacgcctgtaatcccagcactttgggaggccgaggtggacggatcacgaggtcaggagatcaagaccatcctggctaacacagtgagaccccgtctctactaaaaatacaaaaaaattagctgggcgtggtggcgggtgcctgtagtcctcagctacttgggaggctgaggcaggagaacggcatgaacctgggaggcagagtttgcagtgagccaagatcgcaccactgcactccagcctgagtaacagagcgagactctgtctcaaaaaaaaaaaaaaaaaaaatgtacagttcactactcgggaggctgaggcaggaggatcacttcaacccaggaggcggagattgcagtgagctgagattgtgtcgctgcactctatcctgggcaacagagtaagactctgtctcaaaaaaaaaaaacagaaaacaaaaaaaacaaaacactgtttagtggcatggagcacattcatgtttctgtgcaaccgccaccccatccccatccccatccccatccatctccagaactccttttcatcttccccaactgaaactctgtcctcatgaaacacgccttattgcccctccctccagccctgccctggcaacctccctcgtactctctgctctatgaatttggtgattctaggagccttatataggcagaatcatacggcatttgtccttttgcgactggcttctttcagttactgtaatgtccttcagattcccccgtcctgtagaaaggaatttccctcctttctaagcctgagtactattccatcgtatagaggatacagcatgttgtgtttacccattcattcatccttggacactggggtgccttccacctcttggctgtagtgaataatgctgctatgaacaaggtttggcaaatatctgtccagtgcctgatttcagctgcttgaatacattgttttaatttattattattattttttagagatggagtctcgctctgtcaccccagctggagtgcagtgttgtgatcttgggtcactgcaacctgtgcctcctgggttcaagcgattcttccaactcagcctcctgagtagctgggattacaggcatgcaccaccacccccagctaattttgtacttttagtaaatatgggttttcaccttgttgactgggctgatctggaattcctcattgccaggtaactatttcacagcctggtatggatccttctgtacttttctttgtgttaaaaaagccccctcacacaaacgcacacacacaagcacgcacacacacaagcacacacacgtgcacgtgcacacacacatgcacgcacacatatatgcatgcacacacacacacgcgcgcgccccgtgcagttttggcctcatgccactagagtatgcatcatttttgtctcttgttttcttggagatccctctggggtattttgaggaggagaagttgtattattattgtgttgttgttaatctttagacattcagggatacacgtggacgtttggtacatggatgtatcatgttatggtgagctttgggcttctagggtaccccttacccgaatagtgaacattgtacccaataggttatttctcagccctcaaccccttcccagccttccccttttgggagtccccgtatctgttatttccatttctgtgtccatgtggacccactgttgagctcctacttttgagtgagactatgcggtatttgactttctgtgtctcagttattttacttaggatagtggtttccagttccatccctgtcgttgcaaaagacatgattttattttttatggtggtgtcgatatactacattttctgtgacttttatatactaaattttctttatccagtcatctattggaatggctgttacaaaaactcaaaaaaatccaggcatggtggcccacgcctataatcccagcactttgagagacccaggcaggaggatcgcttgagcccaggagttttagaacagcctgggcaatatagggagaccctgtctctacaaaaagctcgaagaaatagcgagggatggtgttgcacgcctatagtcacagttcttcaggaggctgaggtgggagaattgctcgagctcaggagttgaaggttgcagtgatctatggttgcgccactgcactccagcctatgcaacaacagagcgagaccctatctaggaaaaaaacaaaaaagtaagaaaacaacagatgttggtgtggaagtggaggaaaggggccatggatgcgctgctggtgcggaggaggtcttccagtgcgtgcagcaggggaggtgacctcacttctcctcgagaggagctcagctgtgcaaggcagtgttgcagaggatgggagggtgcatgtgaccctaggagcaaggctgtgtgcctgtgggcatgtacttcctggtgacgtttccttggaccccacagtgggaaacaggagcccctctgccctctcattcctctttctctgtatttgcattcgctgtcttgctggtctcaagattcccaagcgctgctgccagcccaccccttcagcctgccaagctacatgtgtgcgcccacttgaccactctctgagccttctgctcagatgcctctcaccaaaaatgagttcctgctcttcctccttgcccctcagccctaatcagttcctcatttgcacttccccatttcataggtggtccttccagctcttggggctcacccaggaaccattttttattccttttctttgactctgcattcactgtaatcctgagtcctgcccttttaacttttttttttttttttttttttaagagatgtggtcttgccgtctcatccaggctggagtgcagtggtgcaatcatggctcactgcatccttgacctcctgggctcaagagatcctcccacctcagcctcccaagtagctgggaccacaagtgcacaccactatgtccagctaattgaatttttgtgtgtgtgtgtgtgtgtgtgtgtgtgtgtgtgtgtgtgtgtgtagggacaagatctcactgtgttgctcaggctggtctcaaactcataatttcaagcatttcccctgcctcagcctcctaagtagctaggattataggtgcacaccgccatgccttgcccctttccaattctcaaacacatctccagagcccatccacatcaatgatgtcttcacagaagctgccatagcttatctaaattccctccccttctctccactgatctctgatctctgctgaactcaccccttcctgctgtatcagcccaaacgtttctgatgtgaaaataggcagggcgtagtggctcatgcctataatctcagcactgtcagaggctgaggtgagaggattgcttgaggccaggagtttgagaccaacctgggcatcttagtgagaccccatctctaattttttttttttttttttttttaaagacagggcctttctctgttgcccaagatggagtgcagtggtgccatcatagttcactgcagcctcattctcctgggcccaagttatcctcccacctcagcctcccagatagttgggactacaggcctgcaccaccaagcctggctgatttttaaattttgggggtcttgctatgttgcccaggctgatcttgaactcctgggcacaagtgattctgctacctctgtctctcaagtagataggagtacaggtgcatatcaccatgcccacctaatttttaatttttttttttttttttttttgagatggagtctcactctgtcccccaggctggagtgcagtggtgtgatcttggttcactgcaagctccgcctcccaggttcacgccattctcctgcctcagcctcccaagtagctgggactacaggcgcccgccaccacatccagctaatactttgtatttttagtagagatggggtttcaccatgttagccaggatggtctcgatctcctgacctcgtgatccacctaccttggcctcccaaagtgctgggattacaggcatgagccactgcgcctggccctaatttttaattttttgtagagacgtgatcttgctttgttgcctaggctggttttgagctcctgggctcaagcgatctgccaccttggccccgcaaagtgccggaattacagacgtgagccaccgcacctggcctccagctcttttgtgtccctccccaatcttcctttggccttcagctgtggggacagagatgccccctgcctccctgtccccaccttctacctggtcttacaggaccccctccagccatccttccaagtttactatgtaatgtctgttccacatcaagcctgcaaagctcatgacagtcacaagatctgccgttcctgatactatgtaccgagaacattacttggcacataaggggcccttgtccaaaacatttggaaaccaataaagaatgtggctggtgagttactgattaatgtgttgatgaattcattgattgctgaggctagtatgtacagtaagtgttagatcttgaacatacttctcatatccattgtgataaaccctcttatcttctattgcttttgaacttttatagacttgatgtcaggggcagagtccctcaggtaactggaatcattgaactgatgcattggtttctaattttctaagctcagatttgaaatcacctgtggtcactaaactcgtcctatcccacagcccctgcacatgatgacttaagttttgtgaatgttttttggagatagtaaagtcagtatctctttcaacattttgttccttatctttagtgatacccagctctgtacaaattctgtccacgtaagcaaagtctttttttttttttccagatagggtctggctctgtcactgaggctggagtgcagaggttcagtcatagcttcaactcctgggctcaggctgtcctgctgcctcagcctcttaagtacctgggactacaggcctgcacaaccacacctagctaatctttttattttttgcagagacagagtctccctattttgcccaggctagtctcaaactcttggtctcaagtgatcctcctgcctcagtttcccaaagtgctgggattacaggtgtgagccaccacactcgcctgcaaagtcttactgataaaagatttgaaggaaggatgtgtcagagaacttcttttttcttataatatttacttaatcttattggtttggggaagggcaagagaatcccagttatctagatttttctttttcttaaaggagtatgtttttacttgctaactctctttgtaaactgttacttcttaaagatgctgaagggtgatcccgcattagtgtataggtaaaaatgatgtctccatttcatatatactgataaggtgactttattaagccttgtggtttgttgatgttgattttactgagacacttgtggaacagatgtattttcatacaaccttacacatctcagtagttttccccactcgtgcagtaactttttctcccctgctttctctcctcctctccccacctcttcttccttcccctcctctcctcgtcccttccctcctcttctcatttgatacaaagccctaactctcttcctctacagatcatcctacccatggttgaaattgcaacttcccctgcaagccaagtgaccgaacctgagatgtttgtattgtcagggcttgcgtattctacatgcctgtgtaatcctcaaagttctttcattccttgcttctaacctacccaaatccttctaatctcccaccatggttaattatctctgatgctcctgaaaggtgacctgctgctacattgtgacaaggtgatgcattattcttaagaggatctgtgcagattattatcccagagtgaggtagatgggggaggatacaggatatatccaaaaatgtgttgcaagctaattgatagagagagagagagtgtgtttgtatgtgtgtgtgtaagcatgcgtccatctttttcttacatatttgagccatagggaagtagagccatgtatattctcttcaaccaaattaacagttgtagacagtggtcttgctattgctttgactattaatggtattttcaagagctcagtgttacccccaaatgttcagtatcacaccttggctggtcagtcgtagctaaattttccttccaccttgcgccctgaagaaatttagaaagtcaccagctgacacagaagtttattgtaaaagttcactagtacgatagtatttggaccttggaaaatatttccccaccagaacagtgaaatcatgaaatcatggttgtcttctaagctcatccacaaaagtacagtttgactgtcatgcatttgagatgccatgtgcttaatcacgaaatattactgagaggaacactcttgcccaaccaataacggtgcaaagcagaaaaacagggcatttagctgggagaaaatgagtcgagatgtcagtgataagatggaaggaatgtgggtatgtgctgggtcttttagaactccagcagattgctctggaaaacagccactacataccaaaagtagccggtcatggtggcatgcgcctgtaatcccagctactcgggaggctgaggcgggagaatcacttgaactcgggaggcggaggttgcagtgagccaagatcgtgccattgcactccaagcctgggtgacagagcaagactgtctcaaaaaaaaaaaaaacaaaaaaaaaaacaaaaaaaacaccactccaacaaaatacttctccttcctcatatagtgtccctgcttccctttatgcctcaagaccacacattttgaacttgctgagctataagaagtgaatggagaggtgggacacaggtgcacagccttcagtaactgaaggaaaaaaaacagaagaaatgtctaaccctgagcttcctgagctcccttcagccacccagctgctgaggggcaggaatccagcagcaaggtggagagcagaaggcattcctgcaacctgtatgtgtgggtcattagtcccccacctccagcatcattgcagaatctgcaaatttaaaagtgcgttaggtaagagccttttttataagaggcccatatttttgctaatacataaaaacattgtgattagtcaaataaatgttcatttaaaattcacagtagcatgtgtctatttttttttttttttccttttagaaatgaggtcttgctctgtcacccaggttggagtacagtgatgttgtgatcatagctcactgcagcctccaattcctgggctcaaatgatcttcccacctcagcctcccgaattgctgggatgccaccatgcctggctgattcttttattgtagagacgggatcttgctgtgctgctcatgctgctttccaacacctggcctcaagtgatcctcctgccttggcttcccaaagtgctggaatgacaggcattgagccgccgtgcccagcctatgatttttcttagcattaatctctgtgtcattgcaagctgtctcccacgtccttgccttcattctacattgttttggtggaatggcctgtgctagcagacaagaccatccggtcgaccttgagcatccttccctgtcctcagggaaggtttcctgggcctcattttgttttctttgtataccagcggggtgcagctcatttgaatgagcttgcaggggagcatctgtgatagcatcatgatcagatgagacaaaactggcacgggtcctggtcatggttgaagacctttatgctcctgattctattgggtgtcttctactggtgaaggctcatgtgctcatgggaacacgggcatgctggtgtcttccgagtcctctccaaaaacaaagcccaggtcaggtacagtggctcacgtttgtaatcccagcacttcgggaggatgaggcgggaggattgctggagccctggagttcaaaaccagcctgggcaacacagtgagaccctgtctctacaaataacagtaaataaaaattagccaggcatggtggcatgcacctgtagtcctagctacttgggaggctgaggtgagaggattgctcgagcccgggaagttgaggctgcatgagccttacctgcaccactgcactccagcctggcagacagaataagaacctgtttcagaaacaaacagaccgggcacggtggctcatgcctgtaatcccagcatttctggaggccgaggcgggtggatcgcctgaggtcaggagttcgagaccggcctggccaacatggtgaagccccatctctactaaaaatacaaaaattagctgggcgtggtggtgggcgcctataatcccaactacttgggaggctgaggcaggagaatcgcttgcacccaggaggcggaggttgcagtgagccgagattgcaccgttgcactccagcctgggcaacaagagcaaaactctctgaaaaacaaacaaacaaaaatcccaaagcccttagttccaaatcttgcctcataccccacccgtcccatctttaggtgaaaacgttctttcattatcagtgcgtatctctccaaactgtatttgtaacttgtgctgagatgttgaatgcacagacgcacctcagtatcttctgttccttctttcatccctacccccaccttcctcaatctctcattgctgcgttttcttccattaatcaacacctttgtaaggagaagcacctcaggcaagctcccacaagcaagtgcttcgaaatacttcatttggggctttttaaaagggctaccttttcctagcaggtttgggatgcagtctgctagtttattgttaattctcaggcttaatgatagttccaggttactgaatcaggtgtgatctctgaagatgtgtgtgttgtaggttagttagttagtgctgccataacaaagtagcatagacggtgtggattaaacaacactgatttattgttttataatttttgaggctagaattttgagaagaacgtcttaacagggctggtgcctcctgagccctctctccttggcttgcagacgctgtcttctccctgtgtcctcacgtggtcgtccctctgtgtgtgtctgtgtcctcatctcctcttcttaggactccagtcctgttggaatagggcccattctagtgaccacattttaccgtaatcacctgtttacatgacctgtctccaaatacagtggatattggaaggacacagttcagcccatagcatactgttggctggtttattatgagaccatgatatttactattcattcatcccaagacaatgagaccttttacccatgtcccaggatacacatatcttaacatctgctgttgtctgaatacgtcctttccaaattcatatattgagacagtaacccccaaagctatggaattaaaaggtggagctttgggggaagtgattagatcgtgagggtgaagccgctgaacaggaccagtgccctcggtgaaggggcctgagggagcccgtttccccttggtccatgggaggacagcgagaagggcccttccctcaggaatgggcccttaccacgcagttcatcagcaggcgccccgacctcggacttccagcctccagaactgagggtaatacatttttcttatttgtaagaccccctagtatatggtatttttgtgatagcagccagaatggactaagacaacatctatgtaacatctgtggaacttgtactttaatgtccatctatatgcttatcccagtatctgattatacacctcttaacatctacacacgtcttagcatctacctatactgatgaattacacctttctatatgcagacctcagcacctgtctatacctgtagagtcacatctacacacacgcatatcctaacatctgtctgtatgcacaccttagcatctgtctatcacatatattagcatctatctacacctacatattaacatctacttccacccatatcctaatatctgtctgcacccacagagcaacaccggtctacacgtctatacccatatcctaacatctctctatacctctgttaatatctatctacgttcatattctaacatctgtctttacgtgtatattaacatctctctacacccatatcctactatccatctacacccatattgtaacatctgtctcttcctatatgttaacatctctctacacccatattctaacatctatgtccatatattaacctctgtctacacccgtatcctgacatccatctacacccatattgtaacatctatacgtatagatatcatctgtcttcacctatattgtaacattgatctctatccatattctaacgtctgcctacatccatatcctaacatctatacctacatattaacatctgtctacacctatattccaacatttatctatctgtattttatttgtctatgcccatacattaacacctgtctacacccataatctaacatccatctgcacccatatactaacacctgtctacatccatctacacccatatattaatacctgtctacatccatctacacccatatcctaacatctctctatacctacatattaacatctgtctacacctgtattccaacacttatccatatccatattgtaatatctgtctgcaaccatatcctaacatctatctataactacatattaacatctttctatacctatatgctaacatatatctatatccatatttaataccatatggtaacactgtttacacccatgtatcagccccgatgtacacccatatcctaacatctgtctctaagcacatcgtaacatctgtatgtacgtgcattcgaacacctatctgtacccatatattaacatccgtctttacccatgtgctgatatctgtgtgctccatgtcccgacatctgtccccagctattactgtctgtctgtacacacattttggtatctagctgcatctgtaccccaacacctagctgacggcgtaccccctgccctgccttggcggggccctgagcatgtgctgtctgtccccgcaggttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggtaagaggaacgtgaactccgatggaatctacactgcttggcaatgagaaaggtggtggtagttgtggcaggtcaggcagggaaagattgggaaccagagtttaactctcatgtgtaggagacacttgcaaccagggatgagagagccaggttgacccacagctcgttttaggtgggctgcgattgctggcaaagagccagtgggcaggaagtcagtctccttcactggcaccgtggaggaaatcagaacaccacatatccgctattgatccgaaatgatgaggaaatgagtcatatccaagtttgaattgccctgactataaaatagatctgcatcgaataggatacaatatctcttaaaattaaatgccaggtgctgtggctcacacctgtaatcccagcactttgggacgccgaggtgggagaatcatttgagcccaggagtttgagaccactgtggacaacctagtgagaccccgtctctacagaaatatatatatttaaaaaaaagttgattatggtggtggatccctgtagtcccagctacttaggaggctgaggttggaggattatttgagccccggaagttgaggctgcagtgagctgtgattataccactgcactccagcctgggtaaaagagcaagatcctatctcaaaaaaaaacaaaacaaaaaaaaaaaaaaaaaaaaccaaattgaatattccatacacacctgctcacacacacgtgcacttatttttttctgttatctatatttctattatgtatatatatatttccactatatatgtatattaaatagaaatatatataatactatattattgtatataacatatagtatattttatgtacatatgatatagtattatatatgtatagtatatattatactatatattatatagtatacaatgactatgatatagtatcatataggtatactatatattataatatataatatatattatatagcatacctatatcatactatatcatacatatcactatactctatatagtatatattatacgtattatatattacacatactacatatatatattatatagtatattatactatataatatatataatatatatattacatagtatataatatatatagtatatatcacatagtatataatatatataatatatatatcacatagtatataatatatattatatatatcacatagtatataatatatattatatatatcacatagtatataatatatataatatatatatcacatagtatataatatataatatatatatcacatagtatataatatataatatatatatcacatagtatataatatatattatatatatcacatagtatataatatatattatatatatcacatagtatattatatatattatatatatcacatagtatattatatatattatatatatcacatagtatattatatatattatatatatcacatagtatattatatatattatatatatcacatagtatattatatataatatatatattacatagtatataatatatatagtatacctatatcatactatatgacatgtatgatatatgtgtttcttttctggaaacacacagacataccccaaaacagtgtttgaacaaacatctgggcaccccacggcccatcaacacatgaaacaaaccattacatgtcgtctcagccagtgcgggctgcactaacacacactcatagactgggcagcctcaacagcagacattcatggctcacagctctggaggctggaagtccgagatcgaggtgcgacagattctgtacctggagggaaccagcttcctggttcgtagacggcgccttctcgctgtgtcctcacatggtggaaggggcgagggggctctctggggccccttttgtaagggcactcatcccattcatgagactccacctttgtgacctcatcacctcccaaaggccccacctcctaatcctatcactttggggatgatgatttcaacataggaattttggcggggggcacatacattcagcttataatacatgtatatgtatttttttttccatgattggattcatttaaccagtctgtcttgacaaaagaccacacactgggcattttaaagaatagaccttttcctctcactgtcatggaggctaaggtctgagatccaggtgtgggcagggctggttcctcctgaagcctctctccttggcttggagacgctgtctcctccctgtgtcctcacaggattgtcctctgtgcatgtctgtatcctcatctcctcttcttatgaggacaccagtcctcttggatcaggacccaccctagtgacctcgttttaccttaatgacctctttaaagatgctctttcccatatagtcacattctgaagttctgggggttaggactgcagcatataaggtttaagggatacatttcagcctggaacaagtatatatagatatgtttccgtacacacacatactccattgaggagaaaacagttatccttttttgtttgtttttttgtttttttttgggacgaagtctcgctctgtcgtccaggctggagtgcagtggcacaatctcggctcactgcaacctccgcctcccagattcaagtgattctcctgcctcagcctcccaagtagctgggattacaggtgcccgccaccaggcctagctaacttttttttttttttttgagatggagtctggctctgtcgcccaggctggagtatagtggcatgatctcagctcactgcaagctctgcctcccgagttcacgccattctcctgcctcagccccccaagtagctgggactacgggcgcccgccaccacgcccggctaattttttgtatttttagtagagacgggatttcactgtgttagccaggatggtctcaatctcctgaccttgtgatgcgcccaccttggcatcccaaagtgctaggattacaggtgtgagccaccgcacccggccccagtatgtagtcttttatctctcacccacctcccaccctttaccccaagtccttgaagtccgttgtatggttcttatgcctcagcgtcctcatagcttagctcccaatggatctttaatttacattcataaaatcaacagtcataaaaagtaaattcacacgcccaagctgctgaaaaatactcagaaagatttttggtaactacactgagtgtcagtttttcaattagattaaattaatgaaagtagaattagataatgacatccgttccttggtagacaagctacatttcaaatacccaggattgcacatggctatcggcttctgtcttggtcagacaagcctagaaaatacattttatatttccatattctttgatgtggtggggttgggtaaggtgataattacactaattatactcctaacattgtaaaaccgtctgcattttgagaaacttgatgtgggggcagttttacactaaatgactctcttctctggcagcttttagaaaagggctctcctaggaaaattttatgatgcgtttacattcaatctgattttcccctatagtatttcttgtactacatttccaaaaataaggcacatggaaattaggtgcattttacatggagtaggaaagatgcaggattttttaaaatattgatttatagcatctgtgctgccctctcttggcagcacacggtatattagtaaattcttttaaagtcattttatttgcaagtctaattcaaagaaaacagataaaatatttcatatattcacttgtttataagtttgacaaaccatgttactgtccagttaattcatcatatctatttaaatggacgaaaatggtttcgtatataacatgcagcaattattttacttaatgaacatgtgaaaatcttagaaaatgtctcattaccatattgatagattgcttttgcaaagaactgcatcttcctctgtatgggtagtgtagcttctggaaactttttttttgtgggggcttttttctcctttttttttttgaccatcattgtaacgaagcatctctctgctggcccggccccagggaagttgtgttcatgggggcagatacatggccctgcctctgattcaggattcaaacagtacctgtgccttttgaataaaactgaaattcaccactgtatcgtggaccactacagaatagatggaactaaacagggaggcctcatcttgaataatttttttttttttttttttttttttttaaagacagggtcttactctgtcactcaggctggagtgcagtggtgggatcttggctcactgcaaccttggcctcctgggctcaagcgatcctcccatttcagcctcccaagtagctgggattacaggcatgtaccaccacacctggctaatttttgtatttttagtagagacctggtttcaccatgttgcctaggctggtcttgaacagctggcctcaagtgatccacctgccgcgaccttccaaagcattgggattacaggcgtgagccaccgtgcccggccttgaataacatttttgaacatatcccagaaagaagtctgtttctcatttttctctcttttttttttttttttttttggagaggagtctcgctctgtcgcccaggctggagtgcagtggtgcgatctcggctcactgcaagctctgcctcccgggttcacgccattctcctgcctcagcctcccaagtagctgggactacaggcgcccaccaccacgcccggctaattttttgtgtttttagtagagacggggtttcactgtgttagccaggatggtctcgatctcctgacctcgtgatccgcccgcctcggcctcccagagtgctgggattacaggcgtgagccaccgtgccccgccatttttctcttatagcatggggtaaaaacatacttaagcatgttgtaatgtaatctactcactacatgaatttctttctttgttttttgtttcttttttgagacagggtctcactctgtcacccaggctggagtgcagtagtgcaaccatggctcaccacagcctcgaacttgcaggctcaagcaatcctcctgtctctcagcctcccaagtagctgcaactacaggcttgcacaccctgcctggctaatttttggattttttgtagagacggggtttcactatgttgccagggctggtcttgaactcctaaactgaagcagtcctccaaccttggccccccaaagttttgggattacaggcgggagctacggtactcagcctctccctcccttccttccttccttcctccctccctccctccctccctcctttcctctccctcccctccctcccttccttcctcccctcccctcccctcccattccttccccttccctcccctcccattctttccccttccctcccctcccattccttccccttccctcccctcccattccttcgcctcccctcccctcctctatcctcccctcccctcccctcgcctcctctaaccctcccctcccctcccctcccctcccctcccctagcaaccctgttaactggatgacttgtaccctacttattttaaaccactgctcttggtgacttgatttctgactttcctaggttgtcagtatgttcagatggtgttcttttgtgacttgcgttcaccaggctcttgttttctaacagcaatattacgtttgtattgtaaatattttgcacacacactttatgttatctagatagctcccctaaaagatttggtggcaaactagaattatttctggttttatgaaatggtcaaaataaaatactgatgtgtttaatttgattttataattcaaatgcataacacaagcatcccttacctgaaatacttcagaccagaattgttttggattttagatttttttcagattgtggaatatttgaattacacttacctgtgagcatccctaatttgaaaatctgaaatccaagatgctccagtgaggatttcctttgcgctgtgagcctcatgtcggtgctggaaaagtattgacttttggagcatttgggatttcagatttggattaaagatgctcaacctttatacatctgtctttaaaccataacagatggttttctttctctgcaacagctcttttttgtttgtttttggtgttttttatttctctgcgacagctttttgtttgtttgtgtttttttgtgtttcttttgagacagggtcccactatgttggccaggatagtcttgaactcctggcctcaagcaatccttccacctcggcctcccaaagtgccaggatggtagccgtgagccaccatgccaggtgcaacagctctttcctagttcctctgttgtagcattttaaatccagatgttacattgattactgtcctctggatttttatttctagccttatagggataacattgaacctagtctttcaaaattactacttacccctttcacacacacacacacacacacacacacacacacacacacacacacacacacaggagtagagagagtaattcacattgaaaccttatggccccatcacccagcttcgattgttatcaaagctttgtcactttgttttttttctctttgcccatttgtttcttgagttattttaaagcaggtgcactttatcctatctttaacagataactccctttaaaaaagaacttcagtgccattatcacatctgacaactatttaaaaaaaaaaaacccagcctgggtaacatagcaagacctcatctctacaaaacatcaaaaacaaaaaaattagccttgcataggttaaatccagccccctatgtgtctgttaataaagttttattggaacacagtcacatcttgggggcttttgagctaccgtagcagagctggatatttgtaacagagaccatgtgattcacaaggcctaaaatatttgccgtctggctctttacagaaaatatttgcccacccctgagccaggccatttgctttgtgaactggttaaaattggccaggagctctgtctgtgcagtggaatattatttggccttgaaaaggaatataattctgacacattctacgcgttgataaaccttgaaaacatgatattggacgaaataagccagaccaaaaaggtctcatgtcgtgtgattctacttgtaggagggccctagattcttccaaatcataaggacagaaagtagaatggtgggtgccaggggccggggaggtgcagggaaggggaagatgctgtttaatgaggatggagtttctgtttggaatgatgaagaagttccagcagtggacggtagggagggttgaacacgaaggtcagtggacttcccaccaccgaactatacaattaaaaatgcttaaaatggaaaattctatgctgtgtgtattttaccacattagaaaatcatacatataaaatcataattatgtatataattataaataactatataattgtaatatttacacataaataatatatccgacattaaatttatatatttaaatatatttatctctttaatatattaaatattttagtatattcatatataaatttaatacataaagatattaatgtaatgtgttaattactaatataacaatgtatgtatatattaatatactaatatattctaattataattatatattaaatatgtaatttttagttaaacataattatatttaaaaaataatttaatacaattaaatatataataaatggatacagttttatatttaatattacatatttaattttataaacatggctaccaaataattatatgtgctcataaattatggtataaatatgtttagaaagttatatgtagctataattatacattattatccatagttttatatataattttataaatatatatttatttttaaaatttaaatttatatattagtatgtgttacacatttagtgtttagattataagttcaaatttaaacatatacatttataaatacataatcgttttatatatatttcataacaccagaaaagtctttctagttactttagaccttttcccctagcttcttactttgagtatttaacggaagtcaaggagggcctgagatgtcgagtctgtttgcagtcggtgttgttactttcccttgagccccttttaattttgctgtagttcatactaggacgtgggtattactgtgccgaggttggtgacaggcacccttctccctgctgatcagtggtgcctaggagccattgtcaccgaggaaacccctcccagggcctgggctggccatcggaagctgtcccatgctcgcaaacacacaccttctcccttcacgggcctgaaattctcaactgtttgtccccatcagacagttctaggaactgtgattgtgtccccataaaaaaaaagatgacaaaatcttccctttttatgaaaaaccccacaccctgctgctttattgcaacccaagatcctataagaaaaggcaatgtagtattttcaccatgagtactgagcgaacatctatttcctgcattaccaaacccagacaaaacactggctcatacttttctgataaaaagggaaaaaatgcatttgtatctgtaatcaagtgtaaaagctgtaatcagctgtccttcctcctgagccctaccatgcccctgttagctgagtgacatgctcaccatgtcataaagccatgaggagagacagaaagtgaggctggtgacgccacctgctaggacgtaagagggactggactgaaactcagcttggagatgtcatccgtttctctctgtctctctctctttttttttgagacggagtctcactctgttgcccaggctggagtgcagtggtgcgatctcggctcactgcaacctctgccacccaggttcaagtgattctcctgcctcagcctccggagtagctgggattacaggtgcctgccaccgcgcccagctgatttttgtagtttttagtagagacagggtttcaccatcttggccaggctggtcttgaactcctgttcatgatccacttgcctcggcctcccaaagtgttgggattataggcatgaaccaccgtgcctggcctctttttctctttttattgtggtaaaatacacttaaaatgtaccatcgtaaccatctttattaacattttttatgtttcagaatagggtcttcctctgtcagccaggctggagtgcagtggtacgatcatggctcactgcagcttccaatgcctgggctgaagcaatcctcctccctcagcctcctgagtacttgagactagaggtgtgagccaccatgactggctaactttgaaatatttttgtacagacagggtcttgctatgttgccttggctggtctggaactctgaggctcaagtgatcctcccaccttggcctcccaaagcgttgagattataggcatgagccactgtacccagcctgtttgaaccatcttgccgtgcacaattgagtggcatttattgcatttaccatgtcgtgcaaccatcacctctctctagttccagaacattttcacgatcccaaaagagaacttgtatctgttaagcaattattccccatcctaagccaggatgatctcatcttaacttgattgcagctacaaagatcgtgtttgcacataaggtcccactcacaaatactggggtttaggactttggggggtgcacagttcaaccagtgcaggtgtggcggaaggcgtgggcattaagaacacaggagtcattggatatctatactttatagataatcctatccttagctctgtttctccttcgttaacatggcctcctccctcccctccccccggccatagtgaaactaagaacagtgagaaaactgagaacagcaggtgtcaccttccttctacccaaaagccaggtgagcaaaaggagacaggagcagggaagtggataattcactgcccagaccagtggtctcgacataacactcaggctgtctcatctcatattcattcacgcagtcagcatctctccatagcagcgtatgtctctctgtacattcagctaggcgttggggctttttgcaggaaggagtgactctaacagggcaggagtcctcctgaggcaagttagaacctggatacttatacagcctcatacaacctcaggtgtgtgtccttaccctaacacggagccaaaaagagcctcatctttcaaaaggtaagtggagaagttgcagctaatgcctgtagcatgacctgtggcctctacctgggcttcatatcagctaagatctaggcttttagctactttcaggccactttggatgggctagaaaggtggaaatacaaaactagcaggccagtaagtcgctcgtcttgcagaatgacagaagtgtcgtgcattgaagcagccagggtgtacttggagttgattcaactgctgggcagggcaggggagagcgtgtttctaaaatagtgcgcattgtactttccatttgtagacttaattctaatgagtgagaagcacttaacaggaccacaaggtggtccctgttccatacttagctctaacctgcagatagagagtaagtcccttccacatgcttccatgggaggagaactcaatttctctccttgtcttctttcctggtttcctgatttatatctgctacatcctgcagtaattttttttttttttttttttttttgagacagtgtcttgctctgttgctcaggctggagtacagtgacactatcatgctccctgcagtgttgacctcctgggctcaagtgatccttccatctcagcctcccgactagctgagactacaagtgcacttcagcacacctggctttttttttttttttttttttgtaaaggagtggtcttgctgtgttgtccaagctggtctgaaactcctagcctaaagcaatcctcctgcctcaacctcccaaagtactaggattacaggtgtgaactaccatgcctgaccttgtggtacttttatttcatggatggccgacagaatttgaaatttggatggcagccagtttgttgttatcccaagggcttacagattagtgtggaaaagtctgttgtctggaaagagatggggtatggaggtgtggtggggaagggaaggaaagataacagtaacaacattttgggtgggttcctgcaagcaggaagctgaggagctgaagccaagatacgtgcccacaccactgcaaacagtgcggactcaggcaagatgtgctgggtataaaataggctttgcacatgcttgatacattgtgcaaagaacttgagagtggataaacatgtatattaccagactctgtggaacttgttttttgttctctttacattcaacttacaaaataagggtttcttctttcattgatctgagtggtgggagggaagggtcttttgcaaagcatctatatattttttccctctgagggtgttgcttctttctgcctgtctacagacaggctccacacaccagggcagcacttggcaggaagggtggatgtggcccgcatttgtgctacaggtctgaattgctgaaagcccgaagcgacattctacccagcagtagagcgccaatggagtacggcccagacaaggccccctctctggggttactgatactcagctcctttccagcccatgagtcttccagcttctgctgcagtccttgttatcttgccctgactttatttagcagattcttctgtaaccaaaatgcaggttcagccgctcgccgtttgcagagtgcaattagcaagagcgaggtctagtgtaaagaaagtgattttttattccagagctttcttaggggaagaagtacaggcttcctgcttgaggccacccctttgcttttggagcacaaagcaggcacctttaaaggaaaatggtatgcaggggaggaagtgtatttctgtctttacactggtttccagggggcaagaaatgtttttttggggggtgggggtgtaaagagccaaagagaacatacgtaagctttgcaaaccatccagtctcagttacaagtacaaacccagctcttgcacctttttttttttttttttttttttttgagagagagtctcactctgtcgcccaggttggagtgtaaagtgcagtggcgcattcttggctcactgcaacctccgcctcctgggttcaaacatttctcctgcctcagcctccggagtagcttggactataggcatgcatcaccatgcctggctaattttgtatttttagtagagatggggtttcaccatgttggccaggctggtcttgaactcctggcctcaagtaatctgcccaccttggcttctcaaagtgctgggattataggtgtgagccaccatgcccggcctaagcgagttcttgaattattcttttcactgccacttttttttttggataaaggattttctttttacttaattttatttatttatttatttaaagaacttttaggttcaggggtacacgtgcaggtttgttacatgggtaaactgtatgacacttggtgtactgattattttgtcacctgggtaataagcatcatacctgacaggtagattttccatcctcatccttctcctgtgcttctccttccagcggccaggtgtctgcttttccccctctctgtgtctgtgtgtccccagtgtttagctcccacatacaagtgagaacatgtgagtccacttaggagaatggcctctccacctccgtccatgttgctgcagaggacatgatctcgttctttttcctttaattaattaattttattctttatgatttatactaaggtataaataactcaaaaaaaatgaggtttttttttgcttctgagtaacagtggtaacagtaccagcaacaggagcaaggatgataaaaccaattcttagcttccaagcccgttaagaaatgtttctatggaaaggaatcagcgaaaacaatgttactgtctttacacattaaaatatgtgcacaggagggtaaacggagcgtggttttactcaacgaagttattgtaacaatcagagcttctaaggtgactgcattagccaagcaccactgagtgttgtgggggcctgtctctgtcgcccatataggacttggaccctctgtggaacacccggagtacctagcccccgaagtcattcagagcaagggccacggaagggccgtggactggtgggccctcggcatcctgatattcgagatgctttcggggtaagtagagtctctgtagagaatcttcatcttacaggccagcaccccccttcccccacccattcgtccactcggcatttctgtaaccttgaaaacagtacgtgagtgtcgcaaacacacagtgtggctgcacacacatctgctgccctgctgaggttggcaatgtgaattagcaattgagcttgtgtgaataagaggcaaaaaacccaaacttgtgaaggaaccacccatgcatgcccattgagatttttatattgaaatatccatatcttctttaaatatacaattaacattctgggctgctctgaaggtagtgagttatctcagttgattttcacagtcagctacagattgaactccttgctctactcttttccccccttatcacttctgcgcttgtttagtcttaaaaagaatttaaaaattaaattaaaaaatgaatcttctgcacagaccctttctgaagtaacctgcagagctcaggggggcacaggttgggtcaaggtaaatcagccaaatacagttcagtggtttctggatgaacagctggcaaggaaggcgagaatatgttctttcctaaaaccgtatgtctgtggtacaggaaaggggtcccgacccacaccccagcacagggttcttggatctctcgcaataaagaatttggggaaagtccataaagtgaaagcaagtttattaagaaagtaaaagaataaaagtatggttactccttaggcagagcagccctgagggctgctgtttggctatttcgatggttatttcttgactatatgctaaacaaggggtggatttttcgtgagttttccgggaaagtggtgggcaattcctggagctgagggttcctcccctttttagagcatacagggtaacatcctgaccttgtcatggcattcgtaaactgtcatggcccttgtgggagtgtcttttagtacctaatgcattataattaatgtataatgagccatgaagacgatcagaggtcacttgtcgccatcttggttttggtggcatttggccggctttactgcagtctgttttatcagcagggtctttgtgacctgtatcttgtgctgacctcctatcttgtcctgtgacttagaatgccttaaccgtctgggagtgcagcccagtaggtctcagcctcattttacccggcccctgttcaggatggagttactctcgttccaacgcctgtgatacctgtgttgggtgagatttggaagtcaggagaggtgccatccaccctgcaaccacataacagaggtcggtcatttgttgggacgtcagcatgattgagtgttcaagtctagcatatgcctgagacagctccactatgactagaccagaaacgcaaaggaagcacgcaacacttggaaacccaggacgtgggcgtcatcctcgttccgttgttagtgctaagatgacacagtagcgtggcacttttccagataggaacctgtaggaaggagtgagctacgtgtcagaggaactgttgcaccatgtggctctgcacgaaaggctcttctctctgggatgaagacgagaggaagcccagccagcgagggcccagaacaccggttgggggagcctctgccgcgctttgccacagccgacactctgcctcctaggttctctcttttcctgtttccttctttcttctgcttgcccctgagtctcaaagacagacaccagcgtatcctctgagtggcctccattgtcgcaaaagccagatcctctctcacatctctctgattccctgcagggggtaaagaccagagttttactggggaaccttccctttcagttggaaacaaaggagggaaggaagagaggcattctcctgcctggaaggcgtgtctaagccaggtcctgctggtggggagcaccgagcgcttgttcctgggggtgtggagcatgtgacattctaacatccacctcaggaaatccaggcagtcgctgactttgtttggggagcagacaggggtcatcgtcccatgtgcttatctctgccctcttttataaagaaagtgaatccgttaattcccacactagcttagggatcagaacgatgttgaacaagcactaccaaagaattccaccacaaaaccggagcctgagatgccgcaggaggagagtggaacccgtaaaaacctgtatttcattgtctagctatccatgtgtattgtttatcatccatccatccatctacccacctgtctatttatctatgtttatatacttttccatccatccacccacctaccccccaaccccttcatccatccacccacccaccccgtcatccatccacccacccactccttcatccatccatgtacccactcccccaccccctaccccttcatccatccacccccccaccccttcatccatccacccccaccccttcatccatccatgcacccacccccccacccctctaccccttcatccatctaccaccccaccccttcatccatccacccccaccccttcatccatctaccaccccaccccttcatccatccaccccccgacccccccaccccttcatccatccatccatccatccatccacccacctaccccttcatccatccacccacccaccccttcatccatccacccacctgcccacccaccgcttcatccatccacccaccccttcatccatccatccatccacccacccttccatccatccatccatccacccacccacccacccacacacctatccctgtctatctctatggtctacctattttgtaagtatgtatgtatctgtttatccatttatccttatctatcatctaagttgtcatttatatatttatatatccatctctctccatctctttatctctacgatctttttatctgcctacctacctgttatctatgtatttacctatcatctatctgtcattcatgtaccaatctatccatctacttcctatttatctatgtgcctatccatctatttatcatctgtctttctatgtaactgtttacctccctacctatccatctatcaatcatctatctacctattcatctatctgcttttctatatatctatgtatttatcaatcatctacttacctacctatccctctatctctacctttctgtctatctagctatcaataatctacctacctaccggcctgttggtcttttgaattttccattactctttgctgagacatgcctacaagtcatatagaaccaaacttctcaatatgcaccctagcccattatgtcctaggcaaacccaaaaggttaaaaataacttaggcatattgatcagcgtccacccaaggaaaagcaccacattttccttcggtgataacactgaccacacgagggcagcattgcctgaggatcgttgtatcctgtagtctaatggttttaaatagagtgaggttcgtgtgccccaaattttattgattctaggatagagtagactattattagaatacaatatactattaggacataatattgttagaatacaacatagaattattagactataattaaaacagaatattagtctcagggtacgctgaagttaaaaatacataaaaatacatttaaaaagaatagaatattacactcttagaatgactgtattcgaattatataaagttaccagaattgttaataggctataacattggaatatttaaatatattagaatacaatagaatagaaaataacctaattgtaatgtaataaatcattaggctaattgaaaatgaataattaggccaggcaccatggctcacacctgtaatcccaacactttgggaggccgaggtggttggatcacctgaggtcaggagttcgagaccagcctggccaaaatggtaaaaccccgtctctactacacatacaaaaaaaagccaggcatggtgcctgtaatcctagctactcgggagtctgaggcacgagaatcgcttgaacctaggaggcgggtaggttgcggtgagccgagatcgcaccactgcactccagcctgggcaacagaggtgagactccatctcaaaaagaaaaaaaaaaaaaagaaagaaaatgaataattaaattaaatgaataaccgtctcccaatcaaagcccagtctgctgacctgtgcatttcatgaggcagggagctattgattcacagtaagcctatttttattttccttttttctaattagagtctatttctgggtgaatattgttttttcaatttctcagcagccctgtgtctcttcacatgggtgggtgtcttgagagttaccagcttcgccgaccccaactctcccaggcattcctgtgctcttccccagctccagccggcctgagctcgcctggaccaccccaagccttctcagtctcctgcatcccctcctgcctgcagtacattttcctggaagcagctgcaggcatcctgtccacgtacccatcagctgtgtccctattccctgggagcccgcttgttgcttcccggatgactggagcagaatcggaggctcgttatcatatgaggttctgagacggtctgcctgtgggttgtccacccctcttagacaacagcctggcccctccttgtcttcccactgctttttaaacgtgccaggaagcctgacctgtccccctgcccaaaggctggcttccttcctccttcttttctttttccctttcctttccttccctttcctttcctccctccctccctctctccttccttcctctctccctccctctctctctctctctccttcctcccttccctttcccttcccttcttcctttccttttcctttcccgtctccctcttcctttcccctttcccttttcccctttcccctttttcctttcctttcctttcatttcctttccttcttcctttcctttctgttccgcctcgctctgtcacccaggctggagtgcagtggcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccagctaatttttgtatttttagtagagagggggtttcaccatattggccaggctggcctcaaactcctgacctcaagtgatccacctgcttcggcctcccaaagtgctggggttacaggcgtgagccaccacacccagccagggctggccctttctcttccactgcacatgctgcaggctcacctgtcacctgctcccacagccctctggggcctcccctgttctcctgggccatgccctgtccgaccagcccatctgttttctttatactgattagcagctctgaaaccatctaaattttgtatgtgttgactgcctctgagagcaatgctcccaagctgctctcctcacctccttgaacccagaaacttctggtggctggagggagggcactgctgcacatacaagtggagccggcctgcagtcagagtcttcctgctcccttcgcagcctgtgtctgcacctttcctatcgcagctccatttgctggattcccactcttagcaggatcaagtgagactgtgccttgtctgtgttattgctttaagtgattatctcaatcttccactaagcacagggaaaaccatctatttggtaaaatctgccatgtgattaggaaggagatcatatcatgatgcagattttattttcatggaatgagacatgtttaggtcagatgaaaattgtgtggcacattctggaacaaaatcactcatgcactttccaaggacccaagctcagctccgatttcttccatcctattctctttcctcatccatttctgtggttttattctcccagagagtttaactcaagagtcaggtaaaggctggacgtggtggttcatgcctgtcatcccagcactttgggaggctgagacagaagaactgcttaagcccaagagttcaagaccagcctgggcaacatagtgggaccccatctctacaaaaaataaaaataaaactagctgggtgtggttgtatgttcctgtagtcccagctactcaggaggctgaggtgggaggattgcttcagcccaggaagtcgaggctgcagtgagctgagattgcaccagtgcacatcagcttgggtaacagagcaagacactgtctcagaaaaagaaaaaaaaaaatcagctaaagcatcaagaacaaaacacagggacacacaagacatacagcagagtgcagggtaagagaaagcccctgggccatcttgtcttagttgtgacagcagtgattctcaaagtggcatcccagaggactatggggttcccgaagtgtgtttcagcagatgagtgagatcatttttccaatgacagatctgaatagtgatgaattttcttcataggtgtcaactaagacaatacagcatagcagacagggtgcagaagatcctagagaaggtggaatttggctgcagtggagcctcttccacggggagcattaggcattgcgcagtggttctcaaacatgttggcctcgggaacccttcaacacacagctcaaagttattaacaacccacagaactttcatttctgtgtgttacagctgtccgcgctgactacatttgaaattaaagtagagactgaaatataaaccaacagaatacataaataatatatatgagaagttaaataatcagaggagaacataaatagcatttttaaatgaaaaaaatgtgtaaccacactttctagaattaaaaccattcaggctggacatggtggctcacgcctgtaatcctagcacttcaggaggctgaggtgggaggatcacttgagcccaggagttggaggccagcctgggcaacatagtgagaccccatttctacaaaaaataaaatgaaataaataaaccaattagctgagcatgatggtacacgcccagggtcccagtactttgggaggctgaggtgggaggatcactgaggctgggaggtcaacgctgcggtgagctgtggtctcgtcactacactccagcctgggtgacagagagaccctgtctctaaaaagagagaaaacatttgtgaggaggttggctgtattttctgggttttgtgaatctctttagtgtccagctttcacaagggctgctggcctctcctccctctgtctgcagcctgtctgctgtgctgcgtggcacgttgtttagttgaggcataggagaaaattcatcactattctgaactggagtcagaaaaacgatctcagccatccctaaactgaggtcgggaagccaccctgggactccactttgagggccactgctgtgatgcccaagtcaacgtgcccggggctatattttcaccctctactctgccccaaccctcacacaccccagtgcctgctccttccgctttaactggccctcaagttcccctttctcatctcccacctcagcctccctgattcatctgaggagcacagattttatatttatttattaattattattattttttttctttagagggacccctgctctgtcacccaggctggagtgtagtggcgcgatctcggctcactgcaacctctgtctcctgggttcaagcaattctcctgcctcagcctgccgagtagctggggttacaggtgcgtgccaccgtgcctggctaatttttgtatttttagtagagatggggtttcgccatgttggccagcctgctctcaaactcctgacctcgagtgattcacctgcctcagcctcacaaagtgctgagattacaggtgtgagccaccacgcctggcctaaattttagtttttaatctgaaggtatcgggacaaggatttttgaggaagaagtcaaggtgggatgaaattctagtgaaattctagtgacggctttcttcttttctctaaaaacctctgccttccttttcttgaatgcatttccaaagcacctgtcttccaaggccagccccggtcctcagaactggagcaggtagtgtgtcagctgatagtttaggagggtgtttttccagctgagtaggagggagaacatcagctcacagcgcccagggtatctctgcctgcaccatccactttactggaagatgtaaataggcggaatggttacattcaaattttactggcaaatgatagagctagtggcacaattggtgtaaatttttttcatttttctttttttgtttttgcagacagttttgctctgttgcccagtcaggagtgcagtggtgcagtcacagctcactgcagcctggacctcctgggctcaagcaaacccccacctccgcctcttgagtagctgggatgacaggtacacgtcactgtgcctggctaagtttttaaaatttttttgtagagatagggtcttgctatgttacccaggctgatttcaaattcctaggctcaagtgatccacctgcctcggcctcccaaagtgctgggatgacagccgtgagccactgcatgagcgttttttttgttttttttttttttcttttgagacagggtcttgttctgtgtccagattggaatgcagtggtgcagtcatagcttactgaagcctcgacctcctgggctcaagcgatcctcctgcctcagcctcctgggactacagaggctgtagctggggaccgcagaggctgtagctgggaacacaggcacacaccagcacgtccagataatttttaaattttttgtagagacgaggtctcactgtgttgtccaggctggtcttgaactcctgggctcaagcagtcctcccgcgttggcctccccaaatgctgggatgacaggcatgagccactgtgcctagcctgggcatgaatttttcaggcgaaaatctggagcttgcattcatgctgattagcagattgtccttgcaagtgtagctgtcaccacagatcaatttaacttgcttaataatgccaaatgccatataatgagaatttattctccacttggtaagaattggaagcagtctgtatgtttagagacagaaatttgagggtttcagagggcactgcccaggcgtccgggggagtgctgtttctcagacacacacacacactgtctctgctttttctttcaggcaagatcatcagttagtgctcacttattatttatctttttccgcttattaatacctttcccatgatcttatgtaatgtctactgtccaagagcacttcgtttaatattctccataaatgtttttaggtatgtatggcacatttcctcctggagtttaatgctccattcctgtatttgtgcattattcacacagctgaatgtattcagacagggtcgccacccaaacccagagagaaacaggaatacaactcccccaactactgttacagagaacgctgcgggcaggtgagggaggacgggctcgggaggttgttaacgtctgaggcggcagggttggcgcagatcgcatgagtgtctgtactcagagctctgcttcccagcctggcctgggtggtttttcagtacgttgtggtggctcgtaactccaggaccagcggcccaaagagataccctattgggaaactcaccttcatgctaaagtgcaaaacaagcaactgaaatgttatttaagaaggaagaaatgctgtgttagggccacgtcgcacgcacctaatcatttacctttctctggtaactttcatttcctcatgtaacccacccccacttctctgtcacctctcccattgatttccatttttgtacttcatatttctcctctttgtttttctttgaatttttctccactgcagtgtattggacagttcatgtgtgtagttctacgtatgaatgtcctgacgctgctgttagaaactaccacagactgaaaggtttaaacaagagaactttatcctctcttagtccgggagaccagaagtttgagatcaaagtgtctcaggactgtactccagggaaggatcctttctgcctctcccagttcctgggggctccagcatccctgggcttgtggccacatcactgcagtctctgcctccaccttcatgtggccttctcctctatgtctctgtctcctcttcagtctcttagaaggaaggccacctgtcattggatttagggccatcctaatccaggacgatctcatctcaagatccttcaattaatcacatctgcaaagaccctattgctgaataaggtctcattccaggtctgggcattaggacgtggacagatctttctgagggccacagttcaatccactacacgtgtatccagttccctctggaggctctaggggaggatactccctgcctctcccagctcctgggggctccaggcatccctgggcttgtggccgcatcactgctgtctctgcctctgtccccatgtggccttctcctctgtgtgtgtgcctcctcttgagtctcttatgaggatacctgtcattggatttgggcctaccctgttccaggatgatctcatctgaagctccttaattctatctgtgaaaaccctgtttcccaataaggtcccattcacaggttgttggggtaagatcatggatgtatctttttggggacctctcattccgtccactccactgaattttgttaaggtcaggaagtgatttggaatctacaggagaattatttttgctcatggacatttctgataatcaatgagggtgtcatttgaaagctccgttttataaggtatttccgttgctagcatacctgaattagaatatcttaagtcaaaagaagctaaatggaaaacatgactttgagccaatatgagtatctgtcctgatcaatatgagaaaatctcagaagtacaacttgtgccacggacatgtaagtgtctagtatacacttactggttgatgaaatggtttggctttgtgtccccacccaaatctcatgtttaaatgtaatccccagtgttggaggtgggacctggtgagaggtggttggatcatgggagtggtttctgacagtttagcaacattgccctagtacagtctcatgatagagttctcaggagatctgatggttttaaagtgtagtacttgcccctttgctcgctttcactcatctgccaccatgtaaatgtgccttgcttccccttcgccttccaccatgattgtaagtttcctgaggcctccccagccatgcggaactgtgagtcaactcaatctcttttcttttcttttttgttttttgagacagagtcttgctctgtcgcccaggctcgagtgcagtggcgtgatctcggctcactgcaagctccgcctcccgggttcacgccattctgctgcctcagcctcctgagtggctgggattacaggcttccgccaccacgcctggctaattttttgtatttttagtagagacagggtttcactgtgttagccaggatggtctcgatctcctgacctcgtgatccgcccaccttggcctcccaaagtgttgggattacaggcgtgagccaccgcacctggcctaaatcttttttctttataaattacccagtctcaggtagttctttatagcagactgaaaatggactaatacagttgacttctagatgttcttggatttatcttggtctttgcagttttaagtatatatatttttttagtttgtttcacatattttgaacatttctaggtattagtaaagtctgctggtttctgcagcaggactgtaatctttttactacagtcaacaaagcatagtatgacaatcttgtttttacacatgcaccattttcaaggctgtatttgcatgtatttctgtctttttcctggtctccaggggtcaagaaatggttttcttggggcaaagagcttcggtcagctttgcagactacccagtctcagttacaagtacagactctgctcctgcaccttaaaaagtagtcacatagtgagaccgcatccctatagaaagtcaaaaaattagccagacatggtggcacacacctgtggtccccgctacatgggagcctgaggtgggaggatggcctcctgggggaggtcaaggctacagtgagctatgattgcaccactgcactccagcctgggtgacagagtcaaaccctgtctcaaaacaaaagaaaaatatgatatctcaggctctttcatttggcctgtacacatttattgagcacctgttgtgtgccacatactgttccatgaatgaggaatataaagaaattcagtaatgggtgtggtggctcacatctgtagtcccattactttggaaggctgaagtgggaggatcacttgagcccaagcgtttgagaccagcctgggcaacatagtgagaccttgtctctaccaaaaattaaaaaaaaaaaaaaaacaaaaccctggcgtggtggtgcagacctgtagccccagctgctcaggaggctgaagtaggagcatagcttgagccctggaggtgaaggctgagtgcactgagccaggatcacgctgcagtactccagcctgggggcaacagagcaagaccctgtctcaaaaaaaaaaagtagttcactgacattcacttgcagtttattgaggatgccttatagtgccgtgcaagcaggctcagtaccgggctggacataatcaggtattgctcgtgctgtagagtgaaggaagcctcgagaaaggtgtcctgttcttggccatagtggcgtattcaccactgtaaactttattttaacaattattttatatttcatttcatttatgtactccatctctctctgtcacccaggctggagtgcagtggcacgatctcagctcactgcaacctctgcctctcaggttcaagcaattctcctggcccagcctcctgagtagctgagattacaagcaccggggaccatgcccagctaatttttgtatttttagtagagacgggtttcaccatgttggccaggctggtctggaactcctgacctaaagtgacctgcctgcctcagcctctcaaagtgttgggattgcaggcatgacccacagcatccagcctattttatattttattttattttgagacaaggtctcactctgtcacccaggctggagtgtggtggtgtgatcacagctcactgcagccttgacctcctgtgctcaagcgatcctcccccctcagcctcccaagtagctgggaccacacatatgcaccaccacactcagctaatatatatttttttaagactgggttttgccatatttcccaggcttattttattttttaaattgacacataataattgtacatattcatggggtagacagtgatgctttgatacaaagaatggagtaatcagatcagggtaattagcatatccatttcaattatttaccatttctttgtgttaggaacattcaatatcctctatgtatttgaaacaatacgacatgttattgctaattatagtcaccctacaagactatagaacactggaacatattcctcctatctgcttgtaattttgtatcctttaacaaacctctccctatctctcacttcttcccttcccagcgtctagtatcctctgttcttctttatcctttcaggagatcagcttttttttagctttcatgtatgagtaagcacaagtgctgtttaatgttcttttcctggcttatttcacctaacataatgtcctccagtttcatccatgttgctgccagtcagaggattgtattccttttcatggctgaatagtattctactgtgtgtagataccaccttttctttacctatctgctcatctgttgatggacatctacgctgattccctatcttggctgttgtgaatggtgctgtggtaaacatgggcgtgccgatgtctctccagtatcatgacttcctttcctttgaacagatacctagtaatgtgatggctgggtcatatgggagttctatttctagcttttctgaggaacctccatactcttctctatggtggctctactagtttacgttcccaccaacattgcgtaagagttccctttttggccaggcacagtggctcacgctggtaatcctagcactttgagagaccaagctgggtggatcacttgagcccaggacttcaagaccagcctaggcaacatggtgaaacccccgctctacaaaaaaaaatacaaaaattagctggcatggtggcagatacctgtgatcccagctacttggaaggctgaggcaggtagatcgcttgagcctgggaggcagaggttgcagtgagctgagattgcaccgctgcactccagcctgggagacagagcgagatcctgtctcaaaaaaaaaaagagttcccttttctccacatcctcaccagcatttcttatttttgtgtgtatgtgtcttttttttttttttttttaattttttttgagacagagtttcactcttgtttcccaggctgaagtgcaatggcatgatctcggctcactgcaacctccaccttccgggttcaagtgattctcctgcctcagcctcccaagtagctgggattacggacgcgtgccaccacgcctggctaatttttgtatttttagtagagatggggtttcaccatgtcggccagactggtctcaaactcctgacgtcaggttatccacccgcctcggcctcccaaagtgctgggattacagtgtctttttgataatggccgtcttaattgggttgagatgattgacacctcattgaggttttgatttgcatttccctgatgattagtgacgttgagcattttttttcatatacatgttggccttttccatgtcttcttttgagaaatgtctgtgaagaccacctgtccattttttaattggagtgcttatcttttcgctcttgagacatttgagttccatgcttggtcatggtggtggattcaccccggtaaacatgagagagcattgctgtccagtgtttagtgcacagttaaggaatgggctggtggcccctcaataagatgcccaaaggagttgccttctgctcagcagacgcctctcaaatggtctttatattctctccaagggagcttcccctgcatcggactgtggcacacgatgccttgcctcttagaaccatctgactgtcacgtgctttcagatcgtgacaacttcagtgtgcggggaagagcatgtgaaataaattaccttctgcctgtgtgaagcagaaatagctatcgttacaaagcagggatttttttccatgcttactccccactaaaaatacatgtttgtttttctaacaggtttcctccgttttttgatgacaacccgtttggcatttatcagaaaattcttgcaggcaaaatagatttccccagacatttggatttccatgtaaagtaagtaaaccgtttgcctcatcatgaggtgtgtttatttttaaagtgtctaaaatcaccgtgaaagcacgcactcagcaggataccatattgtgttattaaatgtgctgcgcataaactattttggacagttgtcttttccacaagaaaagaaaaagattttcagtattctactttaatgatagcttcacattttaatgagtcttggccgtattgtgttcttttggtggtatgttatatttaaaatgagccaatgaacgagtttgtcatcgtattttataagagagcagttttggaatttgacaagaaggatcctcctagttctgtggctaacagaactgttgatgggtttagcagagttttatcctttctctcctgcttaaattatgctcaacctctaagtcctttttaacgtcaacattttcagttctgagcatgttgcttcaaggatatttacagttgctggatattggcaactttggatgcacattttataaaggtcgtggcagtagggaaaaaatatattattttcttaaatataagaacgcggctgggcgtggtggctcatgcctgtaatcccagcactttgggaggttgaggtgggtggaacacgaggtcaggagatcgagaccatcctgggaaacacggtgaaacctcggctctactgaaaatataaaaaattagctgggtgtggtggtgggcgcctgtagtctcagctacttgggaggctgagacagcggaatcgcttgaacccaggaggcggaggttgcagtgagctgagatcgcaccactacattccagcctgggcgacagagcaagattctgtctcaaaaaaaaaagaatgcttttggttttctggctaccttacccaatctggtcaactggtagccatttttactgtaataagcactgatttctgtttgtttcactgtatttttcagatgagttgatgggtgcaccagccccctgggcacaaactagagctaaatgcatctagttgagaattaaactttttcttttccatggtctattttcttatgagccggtggaagttcagttcagagaagacttatttcagggcgatggagcaggttgttttgaatatgccccttatggggccactggctacgttcagttgagtttcttggtggtgaacgcaccccatcctaaccagaggttcttagtctgaacagaagataaggtcgtgttttattggcttgagcatgtgttgtgtttgacacactaagaggcaggctttaaaagactttagcaagaaaacgaggctccgcttaacaatgagtcgcctagaagggacaccctgtccagtgaatggtaagacagggaggtgtcaggggaaacagcacctcagaagccgactgctctggaaggaaatagaaaggattatatagaacctctctctcaggccccaaatcccatctgagttgagtgacattatattaagtggatggcaaagcacttttatgatcgagtttggccaggtgaggtgctcatgcctgtaatcccagcacttcaggagcaatccgaagtgggaggattgcttggggccaatccaatagtttgaggccagcctggacaatgtagcaagaccccatgtctacaaaaaatttaaaaattagctgggcatggtagcaagtgcctgtagtcccagctactagggaggctgagatgggaggactgcttgagcccaggaagtcgaggctgcagtgacctatgattgcaccactgcactccagactggatgaaagagtgaaactctgtgtcaagaaaagaaaaaataataaaattaaaagatataattatatatatatatggggggggtttccaatgttctgtggaaacaacaacaaaaaaaggaattgcagaaatagaataaaccagaagcgtaatcaaagtctggtctcttgccacttgtccttctttctctcctagtttatcttctttgagagtagggaaccagcagcgaccatcttggtactgtctgatctaacatgcctctctttatgcagctcccagccccttccagtgttccccacagtgcccctgtttctttacatacccagtgtgggttccccaagagcagaaacagtgatagatagaagtgaactgacagttcacttcttcccattatttgttaaatcttatcaaattggctgagaagcaagacctcaatgactcatatctttcctttttttggtagagatgggtatggggatcttgctgcattgcctaggctgcttttgaactcctgggctcaactgatcctcctgccttgtcctccccaagtgttgggattacaggcgtgaaccactgcacctggccttaatgaggcatttttcttatccaaatcactgtccctggttgtccatgatgctagaattttgattctctgctttttaaagtcatatgttggttcctgcaacttttatcatttgaccaggtaaacatgtcgcctgggcaaatggcacatcaggattgacattccttatagaaataaatatcatttaaaacaaaacaccaaaacaaagctttgggacttgttgccaattcagtagaggtattatctgccggtgttttttacaacacctgaaagtacctgcatctgagaggagccagctggtgccaggatcgtaaataaaatgtagaattttggctacagtgcatcaaaagagtgccggcagatgtgtcgcttatcccggggtcaagggacccatctacagctgtggacacttctgtcgttcctttatagggctttgcatcttcaggggcctcttctcatccatactctttactttctagactgctttataagagtttgctttggtattttactttttcttttaaagagacgggtgtcttgctctgtcaccccggctggagtgcagtggcacaatcatagctcactgcagcctcgacgtcctgggctcaaatgacactcccacctcagcctcccgagtaactggtgctacaggcatgcaccaccatgcctggccaatgttttgatattttgtagaaacgagggtcttactatgttgcccatgctggtttcgaactcttggtctcacgtggtcttcccacttcagcccactgcatagctgggattacaagccactgtcccctgtattttaaataaatcttcattttcttacatgccaaacaccaaaaaaatttaaaaaaaaattcaaggtcatcaaacattttgttttcttacatgacacacacacacacacacacacacacacacacacacgttgaaatttatcaggtgatcaccaaaacattctgaaataaacatagggctttttttcccccctataatttacaccactgcctgccccattagcgtatacacttaaagctgattggactgggattataagaaaacaaaggtttatctaaaatataaaagcataaataaacctgtcttataattgcactccagtgagctttaagtgtgtgtggtaagggggcaggcagtggtgtaaatcacgtgggggacgaagccccacatttatttgggaatgttttgggggtatagtgtttgataaccttgatttttttttggcaggggggagcatgtcaaaataatgaaggagaaactcactaagtagtggaaaggtttctaacttttaggtgatttttatattccccatcctgctcaaagcttttcagccttacaggatggatacaaaatcctagccttaggtgggcggacagatggtctctgagttttactttgtggcagagaagcggtgaagtctgacaagcatcccatcctaattcagaaagcatggtggcaggaaactgtaaaatttccgatcagacagcactggcgagattcacaatctagatggtggagtctgaccctaggacgtcacctggcttgtcggagactccacagtctgtcacagaacctgggagtggctcagtccaagttcgtgctacttaccttggggcatagtttatgctgggaaagcctagacgcttacaccggggtcatgggtattggattgttttgggggacttcaatatattatattattatatcatattatgtatgttattatacataatgtactctgtgtattttatgtgtacacacagacacacatgatcatttctacttccataaatatgcatcttttagaactcacctaatctcctggaagtcttcaacatcatctccaactacccatcctaattgaagcagcttgctgttttttgttgtcgttgttgttgtttgtttttgtttttttttgagactgactctacctctgtcacccagactggagtgcagtggctcagtctcagctcactgcaaccttcgcctcctgggttcaagcggttcttgtgcctcagcctcccaagtagctgggaccacagttgtgtgccagcatgcccagcgaatttctttttctttttttttgtagagatggggtttcaccatgttggccaggctggtctcaaactcctcacgtcaagtgatccacccgcctcggcctccccacagtgctgggattactggtgtgagccagtatgcccaacctccccacctgctgtacttctgacatggtctgttatttaaaaggaagattataagtgaagaagcagacttaggagactcatcctaatgtgtgtgcttatgggaaagccagccttttaaaacaggaatcccatcaataagcagacccccaggacagcgcgtgagtgttgatgttggtgaaagcagatgtcttctattttgcagggacagcctgacaggcatgtttacgttaagtgtctggatcctccctgcaggcacatataaatttcacccttttctactcagaggtgtattttctttacaaagatgtaatcaacccccttcccttagcttcagccttgcacggggcaacccagccttgcataggtgatttaagagccggtgatggtaggaaataagcactagaaagtgttttgccaaagtggaaattgaactgcggtcctcatgtcagatagatcttatctctgttgccatgctgcgtttgctgatgttgatatataatctgtgtactttttttttttttgtctccttccccaacatagagacctcattaagaaactgctcgtggttgacagaacaaggcgattaggaaacatgaaggtcagtatttgatcccgtgggtattcagtggtacccgatgtgcgtgtctgccgtctaacacccacattggcatgtgcaggtataaaccaaggcttagcggtcgtatttaatcactgcccaaatttcaaatctggtgttttatttatttttttaaattttacttgaaactgccaggaaagatctatcaaatctcggtttctgggcccacaacgtcaaactgggtctacaccgtatctcccctcccctcaagcaaggttaatagagcaataacaatgtataagttattactcattattttgtttacttatttattttattttttaaacagttttacggagagtgaattcacacgccatgccatttacccatctaaaatgtgcaattcggtggcttttagtatacacacgattatgtacagccacccctgtggttaatcttagaacatcttcatcagttcaaaaaaagaaaccctgcacccttcagttatcactgtgctattctttcatcctctcttgccctaagccagcggtccccgacctttttggcaccaggggccagttttgtggaagacagtttttccacagaccgcacaacctaaatcccttagttgcgcagttcacaatagggtgtgtgctcctatgagaatctaatgccactgctgatctgacaggaggcggagctcaggtgctaatgccagccatggggagcagctgtcagtacaggtgaagcttcgctcacctgcctgctgctcacctcctggtgtgcggcccattttggttcctcataggccgtggaccactaccagtttgtggcccaggggctggggacccctaccctaagcagccactaatctactgactttctctgtagggttcggtgttctgggctctgctaaaaatggaattgtacaaaatgtaagcttttgcctctggcttctttctctgagcacgatgtcttcaaggttcatccaggctgtagcccgtgtcagagcttccttccttttcctgactgcatagtattcgattgtgtgggcagacctcgttttgtttatccattcatctatggatggacatctgggctgtttccaccttttggcttttgtgaatggttctgccatggacatgagagtaggtgttttgtgtgcgcaggtgatgattttaaaagttgtgcatcaggtatgatttccacaaactttttgtgtggaggcaagtatataattgacaaacagactattccttaagtagtatcatacctgatatgcgtgttttgacatccctgaatttgacagaattcatggactttttgttggccatttctagctctggacaacctcagagggacttatacatggaggaacttccatatacgtcttgaccctgtaaattacagtctggagagacacagtacaccggggtgtgaggcttgaaccacttggctctcttggggccctctgtgtggtttacgagtctccagtagctgccataagaactgaccacaaactaggggcttaaacaacaggaatttctgctttccccatcctggagacgaggagtctgagatcaaggtgtctcaggcctccagaggctctaggggaggatcattcctgcctctcccagcccctgggggctccgggcatccctgggcttatggccgcatcactccagtctctgtctttcttcacgtggccttctctgtgtctgtgtctcctcttctgtctctcagaaggatgcctgtcattgggtttagggtcatcctaatgcaggattatctcttctcaagagccttcccttaattacatttacaaagaccctatttgcatgtagggttccattcccaggtactgggagtcaggacatgggcatatattttgagggccactgcccaatgtgtgataattgtgtctgcttcctgctagaggctctagtgggggatccttcctgcctctcccagctcctgggggctccaggcatccctaggcttgtggccacaccactgcagtctccacctccattttcacatggccttctctatgtttgtgtctcctcctctgtctcttatgaggacacctgtcactggatttagggcccacccttctccaggatgatgtcatctcaagaaccttaatttagttacatctgcaaagaccctatttccaaataaagtgatattcacaggcactgggggatagggatgtgcacatatctttttgagggacattgtttaccctataacagtagtcaagcttctgtcctttacattatttgcggacagcaacgggataccttcaggtctccgaggagcctatccagccaggttgcacggtgtggactcatctgtgccacggctcttcataagattggacgagtcctgttttaatgccacagccatttagaaaagagctgggtctcttgctgggactgcagggaatcacagacgacccatatctagaatctgctgggaatggcgtagtgaccatcataggtaccttccaagggggaagaacaagtttcccaatcaaaggaattggggaaaagctcacaaactcccaagctaggtcttaaagtctagttaaagcttcctgatatggagataaactgaaagagactcaagaaaacactgactttatattttttttaaattaacacatgaaaatggtattatttagcatgtacaacatgaagttttgaaatatgtacccattgtggaatgggtccattgagttcattaacatatgcattacctcacataattaccatttatttgtggtgagaacacttaagatctactctttgaaaaaaattgtttttaagagttggggtcttgatgtgttgcccaggctggtctcgagctcctgagctcaagtgatccgcccaccttggcctcataaagtgctaggattacaggcaagagccactgcacccagcaagatctactcttccagagattcttgagaatacatcattagttatagtcaccgagctgtgcaagccactgactgaacttgttcctcctgtctctctcactttgtctcttttgaccaatgacttcccatctcagccccttcccagcccctggtatccaccattctactctctgcttctatgagttcaacttttttagatttcccatgtaagtgaggtcaggcggtatttgtctatctctacctggcttatttctctctctctctctctcttttttttttttttttttgagacacagcaaggcggaggttgcagtgagccaagatggcgccatgccctccagcctggatgatggagtgaaactctgtccattgccccgcccccccaaaaagaacatagagtatagtaaatagataaaccagggacatagtcatttattatcattaccaagtattaggtgccgtaggtaacgtatgtgttagactgttacacgcctggcagcgtaacaggagggatgcattgtcctgtggttacaatggccatggcgtcactaggggataggagtttttaagatcattataatcttacaggagcaacactgtatatgtcatccattgttgactgaagcatcattttgaggctcatgactgtagatacacacccacacacacactttttttatttttattttttcaagacaggatcttgctctgtcatccaggctggagtgcagtggtgcgatcacagctcactgcagccttgacctcctggcgtcaagtgatcctcccacctccgcctcccgagtagctgggactcagtgcatgcaccaccaaggctggctaattttttatgtttttttgtagagaccaggtcttactttgttgcccaggttagtctcaaactcctgggttcaagcagtcctcctgcctcggcctcccaaagtgctggaatataaacgtgagccactgctcccacccccctcacacacactttatataacacacacacactagtttggatactaatgtgaatctcggtatatacatatactttgtactctacatataaagtgtgtaaagtacatatgtatatgtgtatatatatatataatacatgtgtatatattaacgtgtatgtatataagtatgtgtatatttaatgtgtatatattaacgtgtgtatgtatataagtatgtgtatatataaatatatgtgtgtatatattaacgtgtatatgtgtataagtatgtatatattaacgtgtgtatgtctataagtatgtgtatatattaatgtgtgtatgtgtataagtatgtatatatcaatctatgtgtgtatatatgtatgtgtgtgtgtatatattactatgtatgcatgtgagtatatacagacacacacatcctttagtatccaaattagaattttatctgatggataaaatttattttattctcttattcacagcactcttatttattcttattcacaacattgctgaagggaaaactcaacagctattgtttgttgcctgacttagctatagatcaaaaatacctgttttgcaataagaaaagaaaaagttgtcaaaacaactggatgggaaaacaatagaaaaaattcacattactgtttccttttgaagatatggtcgtggacgtattcctctttaaggataagaaatttgaaactacagtaatgctaactgatagacgcgttaaattcagatgtactggcttctgtttcatggaacctacgtttatttcttctgctgtcccacatttaattgataacgacatcactacaagtataagaaaaggaagcagagtgaggtttacggatgagcacttgggagggatttcagaggtcgtgatggccacagtgtgagccagcgatgcctggtgctacccttgagcatgaagcaggccgacttgaacgcaccttgttaattgccaggccgtgcaatgtcgttcctaaggtctcttaaactggacatccttggtttgagttcccagtcttgttatttacttgctgggtcctacggagcaaattaacatcattccttgaaccctagtttctatgtctgtaaaatactgagtaagtttgccaagatgaaaacaggagacaaactgagaaactactggctgtccaattttatgtcgagagatggaatcgtatttacctttttcgtctttggtccggaatgcaaatgcattgcacaggagcagaatgactggatttgtttctgcggcaaaaaagggcaaacaaaacactaacagctttgcttgcaggttttcctggcagctcaccctccaggcacagttctccaaaatgcagcaaacttggtctgtttgtttcaatactaaaataatgtagagattctttggggtatttttctttcctgccctgtcaaaattctgtacgctgacgacatgtgttgtttcttttgaagaacggggcgaatgatgtgaagcatcatcggtggttccgctccgtggactgggaagctgttccgcagagaaaactgaaggtacaacacatatcagtgggtgactcagtatgcccgagctcttccattagcagggactgcctctgaatcctgggacttctttattgatggctgacatgtgattaatttatataatacaactatttgtctaaaactgttcataagccaagttccccactctttgagtgtcttagtgctaaccatctacctagctcccacaaaggcaggagccaccacacccagtcatataccacatgttctttgtccattcatccctggatggacacttatcccagattttgaagcagattttaggagacctggcctgattcctgactagctctgtgactgctaaaccctactccctcctctttagtggaaagcggtcaacaggattacagagataagcaagcgtctagcaccatggtcatcattcagtgatggtggtgtattacatggagaatattctttggaacgtttctggccaaactgcctatttttaaacatctggctttttggctgggtgctgtggctcacgcctataattccagtactttgagaggccaactcaggcagatcactggaacccacgagtttgagactagcctgggcaatatggtgaaatcccgcctctacagaaaataccaaaattagccaggcgtggtggcatatgcttgtggtaccagctacttgggaggctgaggcacaagaattgcttgataccaggaggcggaggttgcagtgagccaagattatgccactgcactccagcctgggcgacagagccagaccctgtctcaaaaaaaaaaaaaaaaaaaaaaaaatctggcatttttttcaatgtataatacttgtccattttataaatgaggagactgtgctcagagaagttaagcaatgtgtggaaggttacacagctgctaagcagtgtaactatcacaggtacatatttatgggggtacatgttatattttgacacacgcatagaatgtgtaatgatcaactgagggtaaccagggtatccatcagctcaaacatttatcatttttatgggttgggaatattgcaaatctagctattctgaaatatacaatatattgttaactctgcccacccaactatgctgtcaaacactggaacttattccttttatctaacattatgtttatgcaatatttcttcatctccccttcatcccctagctatacacacttcccaccctctggtaactatcattctactctcaaccttcatgacatccatttttttagctcccacatatgagtgggaacacgctgtgtttctcattctgcgtctggcttagtttattatttattatttattttttgagacagcgtcttgctctgttgcccaggctggagtgcagtggcacgatcttgctcactgcagcctccacctcctggcttcaagcagttctcatgcctcagccccctgagtagctgggattacagacgcccagctaatttttgtatttttactagagacggggtttcaccatgttggccaggctggtctcaatctcctaacctcaagtgatccaccagcctcagtctcccaaagaagtgctgggattacaggcatgagccgctgcacccggcctggcttagtttacttaacatgatggtctcccattccattcgtggtgctataaatgacaggatttcattccattttatggccggatagtttttcattgtgtgtatggaccacactttctttatcctttcatccattggtggacacttaggttgattccatatcttggcttttgtgaacactctgaactgcatatgttactgatgggagtggtcaatggtagtgttttcacctttgcacttcagagttaaaagaatggagaatgcttagaaatgcttattcctagtcctcagctcagaccagagtttctggggctggagcctgggatgatacgcttcttttttttttttttttttttttttttgagatggagtctcactttgtcgctcaggctcggggtgtagtgcagtggagtgatctcaactcactgcaacctccacctcttggattcaagtgattcttctgcctcagcctcccaagtagctgggattacaggtgtgcgccaccacatccagctaatttttttgtgtgtttttagaagagatggggtttcactatgttggccaggctggtttcgaactcatgacctcaaatgatccactctcctcggcctcccaaagtgctgggattacaggtgtcagccactgggcctgggctgatgcatcattttgttcaaagttttaccttttcaaatactttattgtattaaattgcattaaaaaaacaatttgaatacgttttatctatccacattggtcaaaaaccaagtcaatattaaaacagatatattgccaagtctccctcttaccccctccaagccacctgtaggtaatcaccttttattgtttttctgtgtatccttctagagtttctttgtgctaataaaaacccacatggatacatgcattcttatttttgccactcatttatacaaatctagagtagcgtagtatgtacattattatagtcttgctttttgcacttgactatataatctggagacctgtctacatacctggctagcttcctcatttttttttttttttttttttttttttttttttttttgagacgaagtcttgctccgttgcccaggctggagttcagtggtgcgatctcggctcactgcaacctccgcctcccaggttcaagcgattctcctgcctcagcctcccaagtagctgggattacaggcacccaccactatgcccggctaatttttgtcttttcggtagagacagggtttctccatgggccaggctgttctcgaactcctgacctcagatgatcctcccaccttggcctcccaaagtgctgggattacaggcatgagccactgcgcctagccagcttcctcattttaaaaaatactgcattgtattccatcacatgactgtaccatagcttacttaatactatatatatatattttgagacaggatctcactcagtcattcaggctggaatgcagtggtgcaatcatggctcacttggagtatcgacctcctgggctcaagcagttctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgctttcataaatgaagggaagacagctttagtgttttgcaaatcattttcatttttaggtacagtgacagaaataaagcggtgtgtgcagcatccaagtgtcccgtccctttctaaccatgcctttgtgcttcggccatgtctcacagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaaggtatatctttatatttagtaattcccaaaaaatgagactgactcgaccccacatccaggtgaggctgcgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatcagaacctgcatgtctaaataagaccgctaggtggtttgtgtgtgcctgaatatttgagaagcccagctcctctggtccctgttccagaaaccctgagtgacaggcgagcttccttagaataattaacaagtattttcaaaagtctctttaggtctcctttggttaaaaaataagaagaagaaatatgccctcataggaaatttgctaagcttaattgaagatgactggaaaaggattttgagtctattacttctttgagcctttgaaggtctattattagtttttaaataataataatattttttagaatccctcatgaaatttgctaagctttaatttaagatgactgaaaaagggttttgactgtgttatttccttgagcctttgaaaatctattattagtttttaagtatggattaaaaagagctttcagttactcctcaattctaaattgctcggttatatggcttcaattagatctttcttcctgtaacacacgagcaagaaacataccagtgaagcaaaatattgtcagtgatgtgtctattcattgacatagcttgtttttcccattttgatttccattcccgtaattttcctgtagtcttcccagttatgtgaagtggaaagccaattggctaaccaacaccattcgaaacagacaccaaatgtcacaattgctgactggggagaggaaccaacctgctgaaagacgtggtgaatgagagccctccatcctgggcaggtgtttacatggatgtaccaagaggaaagctggatacaaattgaaataatagacaacaaaatgatagaggaataggtggctatgacctcgagaagataacctgtctccatggcatggcttcacctctcagtgtgtgatgaacgctttcacagtggtgactggtttgtattaacatgagagcgtgtaactttaccaacttcataaacgctcatgaaatccagttgcgggttttaaaaatcataagatgttcctgaatgtgtttacttctttttgtttctctgctctactctggggcttacattttagctgactcgcccataacatcttacaaattgtgtctctccaggaaatctttaaaatgatgtaaagacttggtttgctttagtatgaaggacccctagttgataagccacaaaaatagaacctttctctaatagagacccctcaattgtaaaatttacttaaagaacaaaaaagcttccatttgatggatttttgtcatataatcagtgaacaatttcattacatcctgtccccagctgcccctactttccctgaaaaagattccacacgtaggaataacctttctccatctggtatgcattgttgagaaagtatgtgtaagtaagtattatttttgctaagtggaatcatttttaatatagtttggctagtggttggggctctgtttaatgaatttttttttctttttgagacagagtctcgctcggttgcccaggctggattgcagtggtgcgatctcagctcactgcaacctccgcctcctgggttcaagtgattctcctgcctcagcctcccgagtagctgggattacaggtgcctgccaccacaccaggctaattgttttgtatttttagtagagatgggttttgccatgttggccaggctggtcttgaactcctgaactcaggcaatctgcccacctcggcctcccaaagtgctgggattacaggcatgagccactgtgcctggcccagatgcaatattttaatccgtcttagtaattttatcaagtaatttgcacaccaaacacatccctggcattttcagcaacgagcgattagttgcaggaattttatgcaggaagatatttcttcatgaagccaaatcttctcctgtaaataagacaccagttcagatgaatcactgcacttgagggcagcttagaaactatgctgtagccgttcatctttgtttgaatcaccctgtatgcctttctgaatgtggaggaggaatttaagagaactgactcactatgtcttttattttactttgtaataaaatattttctgtcttgctgtaaggttctctgaggaagcatgttgaattggggatcccatttttcttgtgcagttcatcatctattggtggatacatttatctatttatggataagcgtatgatagaacattcttcaggctggatgtggtggctcctacctgtaatcccggcactttgggaggccgagttgggaggctcacttgaggtcaggagtttgagatcaagcctgggcaacatagtgagaccccatctctacaaaaaataaaaaagttagccaggcgtagtgatacatacctattgtcacagctattctagaggctgaggtgagaggctcgcttgggcctggaaagttgaggctgcagtgagccgtgattgtgcctgtactccggcctggatggcagagttagacctcatctcaaaaatgaaaacagggctgggcgaggtggctcatgcctgtaatcccagcaccttgggaggccgaggcgcatggatcatctgaggtcaggagttcgagaccagcctggcaaacatggtgaaatcccatctctaccaaaaatacaaaaattacccaggcgtggtggcgggcacctgtaaccccagctactcaggaggctgaggtaggagaatcacttgaacatggaggcggaggttgcagtgagctgagatcacaccactgtactccagcctgggcaacaagagcaagactccgtctcaaacaaacaaaccaaaaaaaccccttacctttaaaacattcttcatttcctttttattggcctctccttttagaattcaggcttatggatccttgcaaaaagaattacaaagagaggttttctttgttatcacttagggaaaggaaacctttgtattatcattgagatgatgattacaaaattcatccagttactgagcaactcacagaatcttttgtcctatttcatgctagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacagtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtggtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctccaaacaagctgtggcttttctcctttggtctaatcgagggatgggcaattatctgtaggggccacatggcagatattttctgcattgtgggacacacagtctctgttgcacagagtgcaaaaaagctgctataattaggcacggaggtgcacgcttgtaattccagtgctttgggagaccaaggcaggaggatcgcttgagcccaggagtttgagaccagcctgcaacgtagcaagacccgatctctacaaaaattagaaaaatctgtcagtagtggtagcacgagcctgggattgctcaggaggctgaggtgggagggtcacttgagcccaggagtttgagcctgctttgagctgtaattgtgccaatgccctccagcctgggtgacagaacaagaacctgactcttaaaaaaacaaaaatcaaaaagccccatagacaatacgtaaacaagtgggcatggctgtgctccagtgaggttttattgacaaaaataatcagagggccggatttagtccaagggccagcatttgctgattcctgttgtagtgtgatgttgactttgcagattggcttcacaggttgttaaaaatgtgctgccctcatcatcatgaatgaataaaatattttattgcttactcttattactcacatatttgacacccaggtttctgagtgacattcgcagcttgctaaaaacatcctgacttcgtacattgtaaaatcaattgatttgtaatttttgacactcacatagcacttgctattagcagaggctgaaatattacacccagctaagggtcaaacacaggcctgtttacttatgaccaagctgtccctggtcccatcttggaattccctggggaagggagtcttcccgtgggctggtatggctgttcagggtctggttcagggaccactcgggagtttctgtagcgtaggttcttggtgagtgacagtctgatttgggaaaggatacggagtgtgtgtgtgttggaaggctaggggaggggtcttgaaccccttcagcagaacaaacatgctttgtactttggggtaagatcgctagagattgtccagggttgtgtcagttatgtgtcatagatatgtattaatatttagccacaccctgttggagctctctgactttcctaggagtcaggctcatcttgtatacttattgaaaggatcagataaccttcttccgagggtatgaaggaaaatcatagttaggtggaccccctcatcttaacaagaggctgtctcgggtatcgctttgcagagatggacaggaattgctggagttttttgttctgttttgttttgctttgttttgcggcagagtctccctctgttgcccaggctggagtaccctggtgcaatcgcagctcactgcagcctcgaagtccttctctcaagcgatcctcccacctcagcctcctgagtagctgggactacaggtgtgcgccaccacacccaattaatttattttttatttttattttgtagagatgaggtctccgtatgttgcccgggctgatctcaaactcctggcctcaagcaatcctcccaccttggccctgcaaagcgctgggactgcaggtgtgaggaactgcagtatggggagcacccgttttctgtgggcagtgacatgcacactgttacatgtgtgtgcaacaaagttatccttcaatccttcaaatactgcaacgcgtgggacacctgcccactctaaccactgctaaaagacaaagctgttgacacgagaactcagcagaaaacaaaatcacagagctaaggtttccattccatctgctcctgctcacaccaaggcgctaaacaacacttcaataataaatatgtgttacataagcataacagaataaatatatgactataatatgtaaatagattaatgtatatttattacatattaatgtaataaatacattaatataatttatgtaatatatatt

SEQ ID NO: 14325 - DNA, 54033 bp, Human; identical to SEQ ID NO: 12091

SEQ ID NO: 14326 - DNA, 39443 bp, Human
  misc_feature (1)...(39443): n = A,T,C or G
tcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacaggtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacgccacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggtagctgccaactgcctcgcctttatgtctcccagtgggccccttggcggaattcagcctaaggagtacctgagaacactggtgcattcgcattacctggtggggccgtgtcaggtcccacaggggaggaggtgatgggtgtggtgggtgacaggctcaccctcctttgtgccgcaatcgaaaagcactgatgtcgagagtagtttggatatgagcaggggagagacaaggagtttccagctctctcttccagctcctgatttctttgaatctctttgactctcctgttttgttactgtaagaaacaccccgccttgtcttttcacgtgtccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggtgaggcctgtgccttttgaggggtgatgtaactgaaggctccctctcagcctacttcccacagtctctgctctctcgggtggggagagccttaccgaggacagggacacagcatcggagtcgctcctgagggctggctttgtgcatggcactgggccaggagctggagacagagaaatgaccccagtgccattcagcaagggatagatggacggtccggtagcggcggttagaggactcatcccagggtctaagtgcacacaatggaaggccctaaggaatgcagagccggggatggaggagcaccccaggcagggaggagggcgggaacagctggaacaaaggtgtggaaggtatgggtgtggaaggtatgggtgtggaaggtatggccgtggaaggtatgggtgtggaaggtatgggtgtggaaggtatgggtgtggaaggtatgactgtggaaggtatgggtgtggaaggtatgactgtggaaggtatgggtgtggaaggtatgggtgcggaaggtatgggtgcggaaggtatgggtgcggaaggtatgggtgcggaaggtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggtatgggtgtggaaggtatgggtgtggaaggtatgggtgtggaaggtaagggtgtggaaggtatgggtgtggaaggtatgggtgtggaaggtatgggtgtggaaggtatgggtgtggaaggtaagggtgtggaaggtatgggtgtggaaggtatgggtgtggaaggtatgggtgtggaaggtatgggtgtggaaggtatgggtgtggaaggtatgggtgtggaaggtatgggtgtggaaggtatgactgtggaaggtatgggtgtggaaggtatgggtgtggaaggtatgactgtggaaggtatgggtgtggaaggtatgggtgtggaaggtacgagtgtggtaggtatggctgcagaaagtcgtcccggtgctgcatggggagtggatccccgaagcatttggggtggctgaaaatgagaagaagggtagcaaaaagtgcggccggcatgcggggaatcctgtaggcaacgggagccagggaggactcagttttgcattgtacaaatggcatttaacaagtggtgcctggagcggtccgatttgcaggcagtgaggaggccaggagagcctgcgggtttccaagcaggaccaggggagggcgccaaggagtcggcagctgcgagaaatatttgggacaaggtttctcacactggagcccgagggcctctagggagtcctaggttaaattggaggagtcttcaagtttatctggagaaaggccgtcttaggaaacaagtctcattccctgaaaagggctttgcagttactcatcttcattgcgctggacttttgtctatttttttttttttttttttgagatggagttttcgctcttgttgcccaggctggagtgcagtggcgcgatctcagctcactggaacctcagcctcccgggttcaagcaattctcctgcctcagcctcccgagtggctgggattacaggcatgcgccaccacacccggctaatttttgtattttaagtagagacagggcttctccatgttggtcaggctggtctcgaactcctgacctcgtgatcctcccgcctcagcctcccaaagtgctgggattacaggcgtgagccaccgcacccagcatagacttttgtcttttaaccctgaaaaggattgagactaagagattgagaatcgtttgctggtattctgacagcaggacctgtttttctccaagctggggaaggatgagaggcgcagtttagggagtaaaatgaccacatgcatttaatgtgggtggagagggagcgagaagcaccctagatggctgcctctggggccctcggggaacacaggacaggtgtgggcagcctgcggggagcgctctgggatccctttcagccctaaagaaggcccaggcccacttggacttcctgctcttctctgtcctggcccaggagtttccctcttcccctatggggcagacgccggggacctggagttcgtcaggaggaccgtggacttcacctccccactcttcaagccggcgactggcttcccccttggctcctctctccgtgattccctctacgtgagtccgggctgcggcccgcgcagcctgaactcccagggcccacttctctctcctgcttcgagacggaacccagaggaagcgggaatggaagcagccttggctgggcccctcgtccatccccacagcctccttaatgtcaggcctctgcctgaggaacacagggtgccaggcgagggctgcccacctgctgggcccaccgctgcttctgcggggccttctcaggagtaaaaagctacacttgggaaactggactgttcctgccgtttccaccttctgggatttgtctctggccccctggtccctgcctcctggagcagagttggagggacagtcctggctcctgtggccctgagggaggaggctgagtccgaacacagcatgagagggcgactgagcgatggagagggtgtccacacctgctgagcgatagagagagggtgtccacacctgctgagcgatggcgagagggtgtccacacctgctgagcgatagagagagggtgtccacacctgctgagcgatggcgagagggtgtccacacctgctgagcgatagagagagggtgtccacacctgctgagcgatggagagagggtgtccacacctgctgagtgatagagagagagtgtccacacctgctgagcgatggagagagggtgtccacacctgctgagtgagagagaggtttccaccccctaagtgatggagatggggtgtctgcacccctgagtgatggagagagggtgtctacacccctgagcgatggaggggggtgcctacacctgctgagcgatagagagaggtttccaccccctaagtgatggagatggggtgtctgcacccctgagcgatggagagagggtgtctacacctgctgagtgatagagagaggtttccaccccctaagtgatggagatggggtgtctgcacccctgagcgatggagagagggtgtctacacccctgagcgatggagagggggtgtctacacccctgagcgatggagagaggatgtctacaccccgaacgatagagagggtgtccacacccctgagcgatgaagggagggtgtctacacccctgagcgatggagagagggtgtccacacccctgagcgatggagagagggtgtctacacccctgagcgatggagagagggtatctacacccctgagcgatggagagagggtgtctacacccctgagcgatgaagggagggtgtctatagccctgagcacccctgagcgatgaagggagggtgtctatacccctgagcgatggagagagggtgtctacacccctgagcgatggagagggggtgtctacacccctgagcgatggagagggggtgtctacacccctgagcgatggagagaggatgtctacacccctgagcgatgaagggagggtgtctacacccctgagggatggagagagggtgtccacacctgctgagtgatagagagaggtttccaccccctaagtgatggagatggggtgtctgcacccctgagcgatggagagagggtgtctacacccctgagcggtggagagagggtgtctacacccctgagcgatgaagggagggtgtctacacccctgagcgatgaagggagggtgtctacacccctgagcgatggagagagggtgtctacacccctgagcgatggagggagggtgtctacacccctgagcgatgaagggagggtgtctacacccctgagcgatgaagggagggtgtctacacccctgagcgatggagagagggtgtctacacctgctgagcaatagatagagggttccaccccctaagtgatggagatggggtgtctgcacccctgagcgatggagagagggtgtctacacccctgagcgacggagggagggctccacccactgagcgatggagggagggctccaccccctgagcgatggatagagggttccactccctgagccccacctaatgtgtcgcaaacttcaggatggggcccaggggactggccaagaggggtgtgcctgtgaggggctggtccacggccagggatctgcagtgaaacaggaccaagcctaccacccgaggacgcaagggatggcctgagggcggagcattctgtgagattatatggaaagggctctccccaaaacaggacacaggaggtgacttccaggggttgttagcatctctaaagctctacccttgggggtcacgcttttgaggagctggaccaaggctgggactttcctccccacttccctccctgaatgctgaccacaaaacccatgtgctcagttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggtgagcctttcaaagcctggcagtcaggatcccccagcagctggcaggggagacaaagagctgtgtggaaggctttgccagagttgctgctgtgacagcccctgcagcaggggactgaggcttaaatatgggtgtgggaggaagcagtcaagggacattaagctgactcaggagtaccccaacccaaccacgagactgaccaggaataccccaacccaaccacgagactgaccaggaataccccaacccggccgcgagactgaccaggaataccccaacccaaccacgagactgaccaggaataccccaacccaaccacgagactgaccaggaataccccaacccaaccacgagactgaccaggaataccccaacccaaccacgagactgaccaggaataccccaacccaaccacgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccaaccacgagactgaccaggaataccccaacccggccgcgagactgaccaggaataccccaacccggccacgagaagacctgcaggtgacgggggatgggggctgacaattcagcctttgattgtaaaatcaggctgtagggggtctgtcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggtaaaagtgggcccgagtggctctgctctctgggccagtttgagctaagatgcttgagttcaagtccagaggtcttggacgtctgggccacgaccctgcattctgcacactgcaggccttcctgcagcccaagtttgaattgaacttcacctcagaaaagctcacggcaaaaatgcaggcctgggacaggggagggcaggccattgggtgggctgaagtgggcagggtcctcaggcagaaagtggggggcccatgtgtaggagtgggaccctcgttggcttgttttcatctgccctcctttcctaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcggggtgagtagacccctgggcagctcccaggagctatctgggagtcagacatcctagaatcctaggcaggggccactcttccaaaatcctctctggctctaggaaagattgctaattatagcaagcccccccaccgccacccccccactgccaccactgttggctgagcactcaccgtgggcccggcctgtctcggccctttgcctacttgacctcacagcagcccagcaaaccgggtattattaggctgaaacatagcaagtggcatttttgtaagtcaaaaatgtctggctattcgcaatttcacgtggctcagtctggtattatgctccccattttacagatgaggaagacaatggttagagaggttaagtaactcgttcagagtcacgccgctggcaaatggcaaagccaggcctgagtggagcttcttctgactccagcctctggctctgaagcacaggctcatccaacgggcacagggtgcgccacaccatctcctctgtcctccctccgaggaccccgctcttgtagtcaccaagttcttccttatgcctggtctaaagtcactcatttcttcattcactcgacaaaagttcactggtcacctactgtggacaacgtgtgcgccttcagtgaaccccagtgtcatccatgctgtttagatggaggagacaatttgggcaatgtccttaaatatccgcgcgggagctaatgaagcctcctctctagctctctggtatcttggctgatctcaggttctggtagctttctctaacaaacactcatctaactgaattgtaacccagaaccctttatctcccctcctggaagaaagtcaccaaaaggcaaatccaccgtggtaagtgcgttcgcacccagggtgaaagctgccctcactgacccaaaacttgccagcattttgggcccatgtctttgctgtgggcagaccaggaacagatgctgtgcgtgtcagagcagggctgtgggacgggcggggggacataagagaggagaccccggatctctcacgggcatccctgtgttttcttccacccacccccagagcaacacctaccaagccatcctctccacggacgggagcaggtcctatgccctgtttctctaccagagcggtgggatgcagtgggacgtggcccagcgctcaggcaagccggtgctcatgggcttctctaggtaggatgggaggggctgtcagcactgagcagttggcagggaggggtgtagagtcggctttcgctgcacacacactcccatcctggggcaaggcgggaaccctcctggctggtgcttctgactcacgctgactccagctcccgctggggccaggcatctggctgcttcccacgacaagatcacccatttgtccgccatgccctttcccatcccagtccccgtgagttgtaatcattcccagagctttggcttccctgatttccactgacattagctggcctctcttaccttctcaaatatcgtgataataacagccaagactgatgacactaacacttcgtgtacattactgcatgtcatgatcacagccaccccacgaggcagatactatttatcatccccattctacagatcaggaaactgagatacaaatagactagcaatttgcctaaagtcccagagctgggaagtggcaacatggagatttgaacccagacatctgaggctagaatctgccttcctgacttcctgagaattacccacttatccagggggcacccaaaagcttatatggagccggtggtgaagggagagaggaggcacggggctgtgggcggttgaaatgtggattcccgtgtgtgggaggctgtctccgatgtagcagtgcgccatctctgttcccatatgctggggtgtggcaatcagtacgaaggccacatgtcttttgttcttgataattgctgcaaatgtcttctcttacattgagtgtgttcaggttacccctttgattacactgctttcactagtttcttggtgtgctatgaaggagaaaggaggggaattacccaactctaggaatttcacacggtccaggtacacccaaggaaggtgtcacgcaggggtgcatcatcctgcttgtgtcagggaggaggaaaagcccaagagtccccactctgcagcaggcacccagggtggggctgcaggcggctgctccaggctttcctccttcccgggccatgctcggaccccacacctggggacggtgatggcgatagtggtggtggtggtggtggtggtagtggtagtggnnnnnnnnnnnnnnnnnnnngtggggcgccgcgcggtgctccggccttcctccttcccggggccatgttgggcccccccccctggggccggtgatgccgataatggtggtggtggtggtggtggtggtggtagtgccggtggaggtgccagtggcgatggtgatggtggtgatggtggtggtaatggtggtgatggtggtggtgttgggggtgatggtgccgatggtggtggtggtgatggtggtggtggtggtgatggtggtgatgatggtggtggcaatgatggtggtgatggtggtggtggtggtgatggtggtggtgccgatggtggtagtgttgggggtggcagtgatggtggtgatggtgatggtggtggtggtggtggtggcgatggtggtggtgatggtggtgatggtggtggcaatggtgatgatggtggtggtggtgatggtggtggtgatggtggtggtggtaatggtgatggtgatgatggtggtggcgatggtggtggtgatggtgatggtggtggtgatggtgatggtggtggtgatggtgatggtggtggtagtgttggtggtggtggtggtgatggtgatggtgatggtagtgttggtggtgacgatgatggtggtggtggtggtagtgctggcgatggtggtggtggtggtggcagcagtggcagcatctgttgtatcaaggcctcactcagttctgagggatttgcagatgttactgcatttaatcctcacaatacagtgaggtagatgccactgtaatcccttttatacagatgtgaaaactaagaatcagagagggtcagtaacttgtctgtggtcaccaagctagtaagtggggggatcagcagttgaatccatcactgcctaactccagaaactgggtcttaaccatcacaatacactgtccctagagtctgtcccgctccaaaccctctgcttgttgaagggaaacaaacagaaatgaggcctgaactctgttgttttcacgcccctgtctcatgaccaagcggacctgccagtttcttgcagctagcgatcagatgtggaatcggttagagcctcctacctctgcccagccatcttgtcccctctcctgctcagtgctggggcttgacgatgggggctggctgacccactgacccactgcccgcctagctggttgaccagctgctgaccggctagcgggatgaatggacgccttgcaaccgcgaggcaagagcctgtgcacggcagaggcctgagagtctctcctttcctgcagtggagatggctatttcgaaaacagcccactgatgtcccagccagtgtgggagaggtatcgccctgatagattcctgaattccaactcaggtaaaagtgccaccttatcacacctgagctggtctcaagccctcgcgtgtcctccagcccatacaccatcgcagtcctagagggcacctccctaacatcacggccatcctgaagggcctcccccacacagttcaacctcctacaggtctaggtgggatgtggcaccacccagggagcagctggcacctcctgcacccctggacacagcacagtctcagagggggctacatctcctccctcagatgaaccagcccaagagggctctcggggggcccagatcctggaagtgaggacagggtcttgtgggaggtgggatttgaatgggcagttcagacaatactccaagtgtcctgtccagagcaggaatgagaacccaggtgagatcctttaagaaaatctaccggctgggcgccatggctcacacctgtaatcccagcattttgggaggctgaggtgggcggatcacttgaggtcaggagttcgagaccagcctggccaacatggtgaaattctgtctctactaaaaatacaaaaattagccagacgttgtggtgcacacctgtaattccagctactcaataggttgaggcaggagaattgtttgaacctgggaggtggaggttgcagcgagccgagatcgcgccactgcactccagcctgggtgacagagtgagactccatctcaaaaagagagaatccaccaagaagaggcccggaggtctcacgttcattgtcatcatttactgggcacctgccgtgtgctggacaccgtgctaacagccagaaacaaaggaaaaagaccaactgtgttttctctcaaagagctttcatgcgggtagaaagacaagcgtcaagaggcaaacaatggcgccttctccatgactcagtccagaggccccaatgggaaagaaataatagtttccaaaatgtgataggttgaaggacattttagccttagaaaccagccacgtgaactgtgaagtgtaaatccagttctatttgttctgtggcaaccacgtttggtcgtcagaagcagacgctaagtcaagcgaggggctttgggggaggaattgttgcccatctgacttgggtccaaagaggtgagaagtggcaggagggggtgcatttgtgagttttggttgaccctaaagctgagacagggcctgcagccccagccctggataagccctttcccccccatccccgacctcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtgacacctccttcccgccccccacaagcccacccaccaccctctctgctcacgccctcagcctctccccagaaacagcccctgcttgttcccaccccgcccctggcagccccagcctgggcctgagtgggactggacttgtttcaggtcgctggggcctcggcagtaggcagctgtgcagcttcacctcttggcgaggaggcgtgtgctgcagctacgggccctggggagagtttcgtgaaggctggcacgtgcagcgtccttggcagttgggtgcgtgagtccgtgatctcaaccccaccttcccggccaagtaggggaccctcagcatgaagcctctcgtcctcattccttcccagacccttcccctctctgggcctccacttcctgatcgggtaacgttaggaagcttccaacatccccaccagcggacattcggggatgtatgagctgagagcctctttcctcatctctatacctggctccacatccccaggccagagtggggccatttctccaggcaagaagagagcgcctaggctgaccccgtccctgtagacccagatgagcaggatgtttgggggaagactgagagtcagctcccacagagacgctccaagggagctggagagcgcaggggtgtggggtcacgtggtctgtgtcctcccgttctctcccccgtcccatggcagtttccacagttcccagaccgtcagctgtgccctccccactcccagcacgttgagagcagcagtacttggctctccaccctcaagacaggaaatttgcttagctcctaccatgcgccctgctgcacagtggccccaatgcctgcaaaagagacagcaccctattcactgcccaaggtcatgagaagggccatgctggattccaaagccatgctcttgccaccaacaccgccctgccctaccaagctctccaccaacaccgccctgccctgccaagctctccaccaacaccgccctgccctgccaagctctcaaccaacaccaccctgccctgccaagcttctccaggtcctcaacctccccgactcactgctgttctccgcagcccaggaactggagccacagagctggtgctgccgctggaatgacaagccctacctctgtgccctgtaccagcagaggcggccccacgtgggctgtgctacatacaggcccccacagcccggtgagcgacagggcccaggcccaggaagagcctctggggagggggagcttctgggcttccgggaggtggttaaggagtaggggcagagctgtggccacaagggaagatggagatgacgccagtgatgggtggatggtcagtggaggggctttgtacctgagttggggaaggagtgagaatagcggggcacgaaaatgcaaggaggcttgaggggaggattctgtgctctgtgaacatctccccagctgagtccgcccggacaagtgccccagtcgactgcagtgaggaacctcaccctgagtcctcctggacaagtgccgcacctgactgcagtgaggaacctcagccctacacatgatttgtcatgctgaggcagcatctcttttttccttccagcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtgagtgaggggtgccggggacctccctgcattccacccacagggaccttcagccacatactgaggccgaggagaaggaagagagcgaaggaggggaagccgggcaggagggagggaggacacagcccatccacgcagctgtcccggagtaaatcctggggatggtggattagggctctggccccacggtttcccagctgcttggcttcgaagaaactacttaatttggttttctcctagtaagaatggggatgacattacctgcctcacgggctgttgtaagagctaaagggcataatccgaaaaccatgcctggccctgccgagcacacggtagacggcggctggcatcacctcaggccgcggcctccagcgccttcctcccggcccagggcgcagcttccagccccaggggctctcccagctgctttcctgggcgtcggctccacctgcgggtcgggctcaggccccctcccatctccttccaggtccaatggctccttgagcctcacgacgcaatccgtgtcctgctggataaccagactgtgacatttcagcctgaccatgaagacggcggaggtaggttggggagcgccggccgccccctccccgcaccgggagcagcgaggtgggcgagaagccgcgttgcggtgcagggccgggcgcgtggcggtgcagggccgggtgcgttgtggtgcagggccgggcgcgtggcggtgcagggccgggtgcgttgtggtgcagggccgggcgcgtggcggtgccgcgccgagtgcgttgcggtgcagggccgggtgcgttgcggtgcagggcccggtgcgtggcggtgcagggccgagtgcgttgtggtgccgggcccggtgcgtggcggtgcagggcccggtgcgtggcggtgcagggccgggtgcgtggcggtgcagggcccggtgcgttgcggtgcagggccgggtgcgttgcggtgcagggcccggtgcgtggcggtgcagggccgagtgcgttgtggtgccgggcccggtgcgtggcggtgcagggcccagtgcgtggcggtgcagggccaagagagcgcagcctctacccccgagcggggcgtgcagctcgccggcctcttctccgcctccagtgcagacccctcccggcttcagccccaggggcggggtgggggtggtgcgggcccggcagggcgcgggtttggtgcgggccgtggtgccgacctggcttcctctccgctgcctcccgatgctccaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggtgagggcggctcggacctgcctctgaggctccgcggagccagccggagctcggacccccacgccggcggcccgggcagccctgctcggcctccctttctccgcctccttggagcagaacccttggggcacagagcgggccgggagccgaggggcttctccagcctcccccgaggctcccttcctgtcctccgcccgctctaagggagcatcagggggggctgcggggaggcggggggcacagccatcctttctccctttcctcttgcctcccacatcctcccgccctcctccaccgctgcccgcgtttcctcccgcccctcccgaaggcagacgggcagggtgtgagggcccgtcctcccggctcccctggaggcctgacagcaggtgcaagagcagaggctgccaggccctggcctctccccactgcgtccgccggatgctccccaggaaggggacagccgcgtgcccagggtggccaacctcccactctgtccctcaggggtctggaataacaatccagaggacgacttcaggatgcccaatggctccaccattcccccagggagccctgaggagatgcttttccactttggaatgacctgtgagtctgggcagggtcctggggcagaggggcaggtgaggggagccggtatgtttatgtcgtccccctcggccctgtaggaagcagacctccatcctccctaaggtctgaggaatctgtgcccccccagggctgtccccaccaccaccagcccacctgcctctctctacctggaggagagaatgggggacgtggagtgtcctctctcactgcagcaggtgtttctagactcagaagctggaaaccgctctggccctgcactcccaccgccccgctccaagccatctaaagtgaggggtagaggtggacacagatggaataaggctgagtgccatgcctggtaccaccgcgctctgtgtgttacagggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcagtaagtggcccgaggcccggggaggccttttcagagtcgggagcagatgaggagctgcccttgcctgaccctgcttttccctgtgcatctgcattcactgagcagattcttccactcctggcattcctctgctcaaacccttcagagacttccctggctctctccatccttgcagtggccttcggcccagttcagcttctcagagctcttctcctagtgctggacgccttcccagccccctccgtccatcctagcgctggatgccttcccagcccccttcactccatactagcgctggacgccttcccagccccctccactccatcctagcgctggaccccttcccagccccctccatccatcctagcgctggatgccttcccagccccctccactccatcctagcgctggaccccttcccagctccctgcactccagccccgcaggctcctctgtgttcttcaaacacgctaggtgcgctcagctcccaggcttcacacgtgctgttctcttgcctggaatacccttccttccctggacagccacacgcttgcccctcacctcctttacgtcttcattccaatgtcccctccttggtgaggcctctcttggccgccctgtctaaaatgtcacattcgcccacacttcatgtttgccttccctgctttatttttttctccttagcatttataattactcaacatattttataattttcacaggtatctttttaattattcattcatgactgtatcctcaccacccagaacagtgccagccacttagctcaataaatgtttgttaaatgactgactgaatgaatgtgtgaagcaactatgaaatggaaatggcagggctccgagaaacagacccgtgaagaggttttactccctctctatttctggacaaatgcaatgtccctttagatgtgaccctccaggttttgtgcgtgtgtgtgtgtgtgtgcgtgcgtgcgtgtgtgtgtgtgtgttgacggagttttgctcttgttgcccaggctggagtgcagtgacgtgatctcggctcgtcgcaacctctgcctcccgggttcaagtgattcttctgtttcagcctcctgagtagctgagattacaggcacccgccaccatgcctgactaattttgtagttttagtagagacagggtttcaccatgttggtcaggctggtcgcgaactcctgacctcaggttatccaccggcctcggcctcccaaagtgctgggattacagacatgagacacccagcacccttcaggttttcagccctttgccaaaggtacaaccctttggtctaagggtacaaccctttgtaatggtccaaacaaatctgctctctaattcactttttgtcatacccagcatagcactgtgttcaggaaagaatctgaaaggagctctttttgaggaggtggggggagagaaagaggctaaagatttggctaggtgggcagtacagtcccagcctgctgtgcgtcagtcgagagcaggtacacagaataattccttcttccagaggtgggtcacagtcctgggaatgcctcacacatattagagttgagaaagagaggaggctgataaagcaggagactgtcctgcctcggaacccccattccctctttgtgtttcagatcagtacccgccctccatcaatggtggtcgtgtgattgaagcctacaaggggcagaccacgctgattcagtacaccagcaatgctgaggatgccaacttcacgctcagagacagctgcaccgacttggagctctttggtaggactatttggctggctggggagagtggggaggtgggtaggggatgaggtcagagtcaaatttgggaaattctgcattgctacacccagcaacacttgctgtcactctttcatttgaatatccaggaccggcatttccgaggagcgatatctataactcaaataggtgccccccagtaagtagtagtgacgggcttacggcggtttggccagatagctagagtgactctgggcacatagaactgattcaaggctgggcgtggtggctcatgcctgtcatcccagcgctttgggaggccgaggtgggcggatcatctgaggtcaggagttcgagaccagtctggccaacatggtgaaaccccgtctgtactaaaaatacaaaaaaaaaaaaaagccaggcatggtggtgcatgcctgtaatcccagctactcaggagactgaggcaggagaatcgcttgaacccaggaggcagatgttgcagtgagctgagatcgcgtcactgcactccagcctggtgacagagcgagactctgtctcaaaaaaaaaaaaaaaaaaaaagattcaaagatcatttaatctcaatctgatcatatatagtcatctttagtcattatgcattcaccaaattattagaataatcaagtgcaacatttaaaatgaccaatttacaacatttttatatctattaaaggaaggctctaatgtaggacaagatttaaagaaatatgaaaaatactttcgtttggtacctttcttgctctttttgtctggtaaccatgtttacctagccgtgtctctccttgtctggtttcctgggctaggacccagtagagtgccatcgctccctctccgtaaaggtgttagagaccccgagccctacatccatgatcagggccaaaggctccaagcacaagggacgctgctttcgtctgttgccagcactaattcaaagggtccaagggcatcaaagggatgccactttctgtctgttgccagcactaattctgagggtgactgttcttggctaaaccaaagccccggggggcatattttgcgttctctttgcctctctgcctgatgttctttttctccgtgtctcagaagggactgctttgcctgcatcccttttgccccacgtgcgtcctcccaggtgcgagacaatggcactgagaggttttcttctccacgggccccacccctgaaggacgatggtctggaaattacgttcgtctattctctgtcacttcctttcaatctgctgttttaaggagactttcctattttcttgaaaaatatcagtttgatctgaagatatgtagtagtgtttcactacagtctggtgtctgaagggggtgtctgggaaaggtccaggaagtggggggtgggtgagaaatcagggcaaaggatggggctgccgtgagagtgaagccagtttggccggcagcgcagcctggggaggtgtctggaggatcctggccttgatcctccatcccccaggatgtcccatcctggtgtgagcccagccagggctgccctttggggtttcttcaggaggaaactgctttcccctctgtggcgttccccgctacaatcagtatgttggactggtgccacgtccttccagctgggagcgtgaccaggatcacccccgataccagccttgctcaaaggaaatgaccaatgagatttgtctggggagggggagggtggcctgagaggggtgggggaagccccgtatcagcaatcagaccacagagctgaggagtctcccagctctcaacattctcatcttccccggggcagagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtgagtgttgggaggtgggggaggagtttctgtgccgaggggagaggaaatgggagtggaatggatgctgtgattctgcctgtcctgggtgtgtctgtgttgggagatgggtggagcagtggtaggtgagtagagcagattccagtctcaggccacaaactcacatgggaagaaagagaactttctggccgggtgcagtggctcacgcctttaatctcagcacttttggaggctgaggcaagcggatcacaaggtcaggagatcgagaccatcctgaccaacatggtgaaaccccatctctactaaaaatacaaaaattagctgggcgtggtggcaggcgcctgtagtcccagctactcgggaggctgcggcaggaaaatcgcttgcacccgggaggtggaggttacagtgagccaagattgcgccattgtactccagcctgggcaacagagtgagactctatgtcaaaaagaaagaaaagaaaagaaaagaaaagaaagaaagaaggagggaaagaaaggaaaggaaagaaaggaaaggaaagaaagggaaaggagaaaaagaaagaaagaaagaaactatattggagaaaaagaaggacgaaagaaagaaaaaggaaggaaggaaggaaagaggaaagaaccttactttattgcttatagttcaactggatttttatctcccacctccccttctgccaggttggcaagaaacttccacctccgtctttctcacagcgccccacagctctgcggcgaagcccagcagagggccctgcggtgtggggtggaaggtggttgtgggtccctgggcgtgagtccacacaggtttccatcacagctccgccccacttccccttcagacccagggagaggctctgctgcttctgtgccttgctcagacacaggacaccttttctgaggccgcttacagtcccgtctgcctagaagcaccccacagtcatttctccctaggatgtcatcatcacggtgctgggaagagagctgcgggtccctctatcttgacacctccaagcccctttgctttctcttttactatctccttccagctaaaagaaacatcttttccagtttggagaaactacttctccatgtttctagccaagatacttggcctaattccacgactcttgtcctatctgcttttttatttttatttttggttgtaaaggaagagccagaaaggaaagtgtttatctggcaacacaaaactacctccttcaccacttacacacacacgcatgcacacgcacacacagacacacacacacatccttctgaagcatgagcagagaatgggtactcgaaagggatagaggtagggacggttggtggggtagggggtagaaaagcataaaatacacaatgggaaaaagagattgaaatcaatatactattccacagatccccaaatatccactcttgggagtagcaagtgttagaggattccattttagggagattccccgagtcgcttcagtaagggagttagaaaggggagcgcagggagcttggtgaggtctcggcgccgcagcctttgctgagctgctgtactggctgctgtgttttctcacagtgctcagcagggaggctctgtcttcttggtttgggagtcagcaagggaggtcaatttcagcttatatgaaatccagtttgcaggccacataggagcctgaggcaggcggattgcttgagctcaggactttgagaccagcctgggcaatatggcaagaccctgtctctactaaaaatcaaaaaattagctgggcgtggtggcatatgcctgtaatctcaagtatttgggaggctgaggcacaagaattgctttaacttgggagggggacattgcagtgagccgagatcgagacactgcactgcagcgtgggaaacagaacgagactgtctcattaaaaaaaaaagcagaagaaaaatacaaaaattagtgggcgtggtggtgcatgcctgtagccccagctcctcgggaggctgaggtgggaggatggcttgaacctgggaggtggagtttgcagtgagccaagatcaagacattgcactccagcctgggcaaccgagtgggaccctgtctcaaaataaataaggaatccagttttcaagcaataggacatacatggatacatacacacatggatacatacacacatggatacacacacatggatacacacatggatacatacatacatgcatgacatacacatacatacatggatacacatacatacatggatacatacatcaatacatatctacatggatacatacatgatacatacacacatggatacatacatgcatacatgcatggatacacacatacatacatggataaatacatacatggatacatacatctatacatggatacattcattcattcattcatgcttcaatcattcatgcatcccccatcttactctagaaaggatttcaggcaaagagctagagtgtgagagggaagaggctgagatcctggtgcagggccaggcagggggtcagggtaaacaatgacccagggaggccagctgggcaggactaccgtgtggctttaggcagggccttgccgccccacggcctggtcaagaaggtgctcagcaggtgctggtggggctgagacatgactcagggtccacgggttctcaggccaaaggggtcagtcagaaacacccagaagcccttcccagtttggtctcctggccgcccgtgatcggcaaccctcctccaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcgggtgagccgggaacagggcctggagcaggcgcttctgggagcagctgatagctcaagggtgtagacagccaaaggcaaaccatttctctcctttttccagcagatctttagaatgctcaatctaggcaggtgtgggaaatctaggcaggtgtgggaaatcatctaggcaggtatgggaaatctaggcaggcctggaaagggggtggtggatggtgtggggctgaaggagaagaggttgtacaggcataggggaggggacggggctgggcatccctgagggcattgatggggggagccccgggcgaaagactgaagatggtttggggaggagacttcagcagccgccagagaaccgggcaagctgggtcctcgggatccctggggatcttcagagacacgaggctcaggatctctgcatctcacgagtcaggacgtttggaggggctggcgtggggatccggcagcaaaggtgcctgattttccctttgagtcctcccagccatctgttcctcccgctctgagtcaccagagtctgatgagggagatcacagcgaggcctttaccaagccccctaaggcacccaaataaaatctacagatcactgtgccttcagagccgaggccagagtgggtagaaccgcagcttttataaaggcagaaaaggagatggacgtgagaggggagggcgtgaggaaagccagctgggggcccctcctctgccagccttcggggtcctttctgaagcagagggtctgagaaacactccagtccctccacaaaagtggaagaatacctgtctggccggggaaaggggttgccctgcagagaaacgcctggaaaaggggggaaggatggtttggggttccgagtggcccgaagtggaacactgggggaaagcaagcctgtcccggagcgggtttccacgggctgggccgtccctctgctgccctgcgcgctgctgctgacctccctactcactctgcagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctaggtaccgccagagaccccgccctctcacccccgcactcttcctgggccccaccctctcacccccgcactccgcccacctttggggaagatgaggaagctctggggtcacaggacagagctccagatttctctgggatggtgtaaggtgcgggctatgggagctggcgaggcaagttgtcacggcaaggaccacgggcctgtgtggcctatggaggaaggacggaggcagagacctcacagctggctcagtgagatgagcgctggggaggcccggagcatagtggagtgagccctagcgtgagggccacttctcccggtttcttcagcaaccttctgtcactgtggaatgtagggtgagggccacttctcccggtttgctcagcgaccttctgtcactgtggaatgtagggtgagggccacttctcccggtttcttcagcgaccttctgtcactgtggaatgtagggtgagggccacttctcccggtttcttcagtgaccttctgtcactggaatggagcagtcaacttgggctggcccgacagactttttgggtaagtctgggtaaaccgtggggtgatgatacatttgcttctcccatctccagaacttcccttaagagtcatccagctcttgctcagtgaagaggaaaatgcctccatggcagaggtcaacgcctcggtcagtgctgcaggccgcgctctgggtgggagggggcgcttggcgggttcaggccagggcggaaccatcgctgtgcggccttcatcttgtcatccatctggattcaactgccagaggaggccggagcctcttgccccatgggaggtgcagggcattaggaagtgaggaaggcccaagacagaaacctcgactcatcataagcagaggccagggtgccaagtcaccccagccgagacctctaagcatcttggttatgatctgaaagaaactaaaggacatttcacctcccgggagtcttccctgacttcccagagggaacgggcggctccctcttcttggctgccatgccatacctcagtcacaggcaaagtggcacaactgccgagtggttggggctgtagaatcctgcacacccagaatcagaatccctgctctgcccctcactagagcaggtgtgctaactagacacatcatataacaggtcatctgtaaacacagggacaatcatagcacctgagtcaacaggccgtatcaccgtttaaatgataacgcgtgtcaagcatttagtcccagtgcctgacacactggtgttcaaacatgatgactgctattatcactactgcgagcctagcactccccactccacactccacacggtaaaatctgttgacatttgtcacctgcgccagacaatgcactctttgagtttagactccacctaagtcaccttgacacccccagccccgaccatctcctaggtctaaacaacccatgttcaatatactggggaggaggtcatgagtcatgtgtcagaggcaaggtaggggccattcatgtcagattctctgctcgtcatatgaggctgagggggggacagaatggaaaacccttcactctcaacaaacattattaagcaaggacccatgacactcactgagctaggctagagtgcaagggtgcagagacaggtgaggaaggtgctggggtcctggggctcccgttccaggaggaaacagggatgaatacacccatcaaggtgggagggcgtctcccccccggatggggcctcacccccacccccatctgccatcctctaacctaggtggcatacagactggggaccctggacatgcgggcctttctccgcaacagccaagtggaacgaatgtaagtgggactgtgtccccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttggataacctcctcattaaacagttgtgaacaggttgtctcatatattgtgtccacattcccatttgacatattataatggtatgtttgaatatagtgtcatattttaaaatacattataataatcattacccattgtttgagtgcttactgtgtgtccggcactgtactgagtactgtggacacattatctcatttaaatctcacagcagcataagtgctattatgatcatttccttttaaagataaggaaactgaagctgaaagagtgaaggaatgttccctgaattacacatctagtcactagcagagtttcagtttccacccaagtctggccaccttcaaagcatgtgctcttcaggaaagcattttccataggaacctttttccacaggaacctttttccctaggaaactttttccataggaagcaccatcccttggtaaggatgtgcagtagtttatttaaccagaccctacttctgaaacgttactattatccaccacgctgatctgaacgtccaggggcatatgtatctgtgcacttctccaattatttctcaggataaacacccgaaaaggaattcgtggctgaaaaggtattgatttagtgttcatcggttgctttctgtgttaatctgtgtccttcccgacagtgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcaggtgcatagggctgtggccaggaggtggaggacagtgctggggaacccaagctgggcaagacactgcaaggggtccaggaattaggatggctcgagagatcagagaccagggaagagaggacagtggaaaaggagagttgtgagtgcctgctctgtgtggagaataaaggcgctatattacaaactctgaaacccaaaagagccataggggggcttagaactatttcgaagatgagaaaactgcagcttagagatgacaaggaacctgccccaggacgcagtaggttaagcagcagggcatggtttccaaagccaaacattttttatatttttatgttttgagatggagtgtcatttgtcgcccaggctggagtgcagtggtgcgttctcggctcactgcaacgtccttctcccgcgttcaagcgattctcctgcctcagcctcccgagtagttgggactacaggcacgcaccaccacgcccagctgatttttgcatttttagtagagacggggtttcgccatgttggtcaggctggtctcgaactcctgacctcaggtgatccgtccaccttggcctcccaaagtgctgagattacaggcgtgagccaccgcgccagggcccaaagtcaaaccctcccacctgatctggctgctgcttccctgctgtctccttgtgggaaaagaacctgcagtcctgtgtctaggccagtcctgcccctcagtcaagcgaggcgcctttgcccctgccctcaccagcagtccccggggctccgctggttaacagcgcaggaagccgcggccccacgcagacctgggctccgggccctccgccagctgcagttccagatcccgccgaaggagggggcgggcggagcgcgggtggggcggggcccggctctccgggtgggcggggcggggcggggccgggctggggcgggggtgtgactgcgcatgcccacctgtggccggcatccctgctgcccaggtgcagctgactgcacgtgcagctgaattcacaccaggtttttgtttttgttttttgagacggagtcttgctctgtcccccaggctggagtgcagtgttgcaatctcggctcactgcaacctccacctcccaggttcaagcgattctgcctcagcctcctgagtagctgggattacaggtgcgcaccaccacgcctggctaattttgtatttttagtagagatggggtttcaccgtgttggccagtctggtctcgaacccctgacctcaagtgatgcgcccgcctcagcctctcaatgtgctgggattacaggcgtgagcccccgcgccggcccaggcccatgtttttaaagcccacacctgcctcctttgcccagtggtctcacttcagcacggcctcagggctgactcagtctctccggagagtggggcgagcccagcctctcctacagaacctcttcttccccagcagaagaggaggggctgggaggctgagctcccgcctctgaccgcctgtctgtctctcttggtcaccagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaaccaggaattccattcctgattttcttctggtggccgaagggctggacacagacttctcccaaccatcagagggcacagagtgtggaggttaagtgctgggcagcagtggagcattaggggcagctggatccagtcctaatcagccccgttacccatgctggaaaccctcagttgctccaccccaaccttgcttcatgctccacatcaccttcttcttcccccaccccagcacaggccaaagcttcgcccgctaaggaggagagcgaaagagataccccaagatggagtgccccagactctctcccaggacccctccctgcctgcctgtccatcagtttcacaaaagtcgtaaaaggatcaatgcacagtgtgtttacctgtctggtggctgtccccaccgcctgcgtttcatggaagagcgattaaaccatttcagctccctttccaggaaccaactcaagaaacatgccaccaccccacccttagatctggagggcccgacccctcatataccctctctgtcctttcccggaccccagatggagtcttctgaggttctccatcccacagcccttcacctctaccctgcctccacttgccccagcaacctgatcagcttccacagaatcctctcagcaggcgggacttttacacctatctggtgtaataactccaacacaattggtccacaattcctgtgtctagaaaatctcaattccaactttatgcagaaactaggtagctgcctcttagttctaaatcccaaatccctgaagagagaatctgactggtccaatttacatcagttgtttatgcctggtccaataaaatgtagtcatggggtcagaaaggaggtcacatggtgcaaagcaggtgttcaagctcattcttgcggatgggtaagtgctgttgaaggaagctcccaaaggaatatctttggttgggcacggtggctcacgcctgtaatcccaacattttgggaggccaaggcgggcagatcacttgaggccagcagtttgagaccagcctggccaacatagtgaaaccctgtctctactaaaatacaaaaattcgctgggcatggtggcacacgcctataatcccagctactcaggaggctgaggcaggagaatctcttgaacccaggaggcggaggttgcagtgagctgagattgtgccactgcactccagcctgggcaacagagcaagactctgtctcaaaaaaaaatatatacatatatatataaagaatatatatataatctttgtattagggttccctagagggtcaggactaataggatagatgtatatataaaggggagtttatgaaggagtatcgactcacacgatcacaaagtgaggtccacaataggctgtctgcaagctgagaagcagggaagctagtctgaatcccaagatctcaaaagtagggaagccgacagtgtaaccttaagtctgtggcagaaggcccaagagcccctgacaaaccaccagtgtaagtccaagagtccaaaagctgaagaactggaagtccgatgtttgagggcaggaagcatccagcacgggagaaagatgaaggctggaagacttagccagtgtaatccttccacattcctctgcctgctttattctggctatgctggcagctgattagattgtgtccacccagactgagagtgagcctgcctctcccagtccactgattcaaatattagtctccattgccaacaccctcacagagagacacccaggaacaatacgttgcatccttcagtccaatcaagttgacactcaatattaaccttcacagtctttgatctgagcagactccaaacttacatggagaatgacttctcccaataggtgaagccactctcctacatacaaagctgtagctttaccctcatatgccccaaagtggaatgtaatgaagtctccatacaaaactgcagtcacagcattcatttatcaagaagcaagcacacagcacaga

SEQ ID NO: 14327 - DNA, 39443 bp, Human; identical to SEQ ID NO: 14326
  misc_feature (1)...(39443): n = A,T,C or G

SEQ ID NO: 14328 - DNA, 5418 bp, Human
gagaagcattacacatcctgggtgctatgcgagcttttttttttttttttttttttttgagttggagtttccctcttgttactgaggctggagagcaaggtcacgatctcggctcactgcaacctctgcctccagattcaaacgattcccctgcctcagctcccgagtagctgggactacaggtgcctgccaccacacctggctaatttagaatttttagtagggatagggtttcaccgtgttggccaggctggtctcaaactcctgacctcaggtgatctacccatctcggcctcccaaagtgctgggattacagaagtgagccactgagcccaaccaggagctttttcgagaaagaaggaagtccaagagatcttcctgacaccctagtctgactctgccctttgcctgctcaaaatttccccatgcttcccagcggccttctggacatagatcaagtcccttctctgacaggcccaaaccctttatcatctgatcctagctcatttttctgagttttccttagttgctattattttctgtctaaagtgacatgtcataatattcataaagcacacaagtcttatgtgtacagctcaatgaattgtaaatatgtgtatacccggccgggcacagtggctcacgcctgtaatcccagcactttgggaggccgaggcaggtggatcacttgaggtcaggagcttgagaccagcctgaccaacatagtgaaaccccatctttactaaaaatacaaaattagctgggcgtggtgtcgcatgcctgcaattccagctacttgggaggctgaggcaggagaattgcttgaacccggaggcagaggttgcagtaagccgagatcgtgccattgcactccatcctgggcaacaagagcaaaactccgtctcaaaataataataataataataataataataataataataataataatgtgtatacccatgtaaacaccattcagataaaaatatggcatatttggggcacccggggagtgtctcttgtggcccctcccctccataccctgctgatctatcagcacagattagtttctgccactttttaaacttcatattccttttctttttacacaaacacaaacattcgagtcatgactgggtggggtggctcaagcctgtaatctcagcactttgggaggccaaggtgcgaggatcgcttgagtctgggagttcagagaccagcctgggcaacatagagagacctcatctccacataaaaagttttaaaaattaaccaggggcggtgtagtcccagctactcaggaggctgaggtgggaggcttcagcccgggaattccagactgcagtgagccatgattgggccactgcactccagcctgggcaacacagtgagaccctgtctcaaaaaaaaaaaaaaaaaaaacaggaaaaaacaaacaaacagaaaagcaggcctggcgcggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacagtctcctgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggtgtgggcccctggggacccagaagtccagccactgggctccttcaggacacaggactctcagccccgcattctcctcctcccctaagaactaggagtctgggccccacaactcagcgcaagcattccggactcccagccctcctctctgccaggatcttaaaaccctccttcagggagtcatttttcccaccttcctaaatgtctgtcttgtccccttcccttgtcccccgttggcctgttgcttttcatttcagcctggcttggggctcagtctccttatctttagtgtgcggtggatgcgggaattttccaccatcagcctgatgcctgctccccggcactggttctcctctctcctgcaggatgattgccgccgtggacacagactccccccgagaggtctttttccgagtggcagctgacatgttttctgacggcaacttcaactggggccgggttgtcgcccttttctactttgccagcaaactggtgctcaaggtgggcagctgcagggcagtgagcccagggatgctccccctcagatctgtgaggacctggggatcgtggtatcaaccccctgcagtggcccagtgaccacagagggcatggagagagatggctgtgcactgggtgtctgctccttcttttattcattcaacaagcatttactggacctgctatgtgccaggcctatacctggcacctgggacacagcactgtacaaagcaggctacatccctgctctcagggagttcacgtgcaggggtgaagtaaagtgggcagagtgatttagcagagtggtcaggaaagatttctattttttttttttttttttttgagatggagttttgctcttgttgcccaggcttgagtgcaatggcatgatcttggttcactgcaacctctgcctcccaggttcaagcgattctcctgcctcagcttcctgagtagctgggattatgggtgtgcaccattatccctggcttttttttttttttttttttttttgtatttttagtagagacgggtttcaccatgttggtcaggctggtcttgaactcctgacctcaagtgatccacctgccttggcctcccaaagtgctgggattacaggcatgagccaccgcaacaagccaggaaagacttctaagggcaggtgacatcaaagagcaggtgacattaaagccaaagctagaatgataagaagcatgcagtgatctatagtgatcggggggaagaggcatctggtagagggaacagcaagtgcaaaggccctgaggtaggaccaagcctcatcttttgacagtagggaggaggccagtgctgttggaacagagtgaactggggagagggtgggaaaggaaggcacagttgggcaggggcagattgtgtggagtttttcgggctgctggaaagactttttcttttcttttttttttttttttttttttttttttgagacagagtctcactttgttgcccaggctggagtgcaatggcgccatctcggctcactgcaacctctgcctcccgggttcaagtgactctcatgctttagcctcccaagtagctagaattacaggcacacaccaccatgcctggctagtttttgtatttttagtagagacggggtttcgccatgttggccaggctggtctcaaactcctggcctcaagtgatccgcccaccttggcctcccaaagtgctgggattacaggcgtgaaccactgcacccagcctggaaagactttaactttactctgagtgtgatgggagtgattggctggttttaaatacggaagcgacaagacctgatttataaatttaagagattattctagcaagtatagatgccccttgacttgcaatggtgttacatcctagtaatcccatcataaattgaaaataacataagttgaaaatgcattcaatgccccgataaacccatagtaaggtcaaaattgtaagtcaaaccgtcataagttggggactgtctgtatagcaaaatgttaattgtagaatctaattataggtggcggctatatggcttttaactgtgaaattcttttaacttttcattatgaagattctcataagaaaatgtggtgggggtggtggggaaatgctcctggctgttgttggccaaaagagatcatgaggcacaagggcagaagcgaggatcctggagaggtggcacctgtcatagtcttgccgaaagatgacaagccctggtggtagcagcagaggtgcggggggggcattttttttttttaagaggtagggtcttgctctgttggccaggctggagtgcagtagtgatcatagctcactgcagcctcaaaccgctggggtcaagcagttctctcgcctcagtctccagagtagctgagactacaggagcatgccaccacgccccactaactgttgcattagtctttttctatagagacggggtctcgctatgttgtccaggctggtctccaacagggagggatatttctttttg

SEQ ID NO: 14329 - DNA, 28109 bp, Human
  misc_feature (1)...(28109): n = A,T,C or G
tgtaagaattagcggggcatggtggcacatgcctgtggtgccagctactggggaggctgaggtggaaggatcccttgagcccagctgtgatcagaccactggcactccatcctaggtgacagagtgagaacctgtctcaaaaaacaaaagctgaactctccagcttgacacgatagtgcagagggaacattctcaaggcaagacatgaaagctgttagttctttaagtcctgggccagaaatggacacaatttcacttgcactatattaaagtggtcaaggcagtcatgggcccgcccagatccaagggaaagggagtccaggagtctgtggtggcttgaacccaccacacccactaatagtatcaggaaacgcttagcacttatcagtgcaggggtgtggcagccccatttcttggaggaggagaggaggagttaaataacacctccaggtcaccagcctgcagaaggcagagcctgtccatgaacttgggcccacctgtgctctttcccaaactctgcacgggcaccaaagattcttacctgttttttcctctgctggcttcctggccctgagcaccgtgcctggcattgtaataaatactctgcaagtattgattttatttatgttatttttattttttttgagacagtctcgttctgtcacccaggctggagtgcagtggcacaatctcggctcactgcaaactccacctcctgggttcaagcgattctcctgcctcagcttcctgagtagctgggattacaggcacccgccaccatgcccggctaatttttgtatttttagtggagatggggttttgccatgttggccaggctggtctcaagctcctgaccttaggtgatccgcccaccttggcctcccgaagtgctgggattacaggtgtgaaccaccgtgcccagccactgcaggtattgattttccaacacatacagggcatttcctgtgtgcgaggcactgctttacaaaatcatcacatttaatcttcaagcaaccccatgaggtagttctgtgaggtagaatcatagaaatggccgtgagtaggccaggcacggtggctcatgcctgtaatcccaccactttgggaggctgaggcgggtggatcacgaggtcaagagttcgagaccagcctggccaccatggtgaaaccccgtctctactaagaatacaaaaattagccagggttggcagtgcatgcatgtaatcccaactactcaggaggctgaggcaggagaatcgcttgaacccgggaggcggaggttgcagtgagccaagatcgtgccactgcacttcagcctgggtgacaaagcaagactccatcgccaaaaaaaaaaaaaaaaagaaatggccatgagtgtaggtaaaatcgggttaaatattggcactttcaaatagttccatctactcatccccatttaacaggtgaggaaacagactcagagaaactcagtaacttcttgttgtttttgagacagggtcttgctctgttgcccaggctggggtgcgggggcacaatcacagttgactgcagcctcaacctcctgggctcaagcaatcctcccacctcagcctcccaagtagctgggaccacaggtgcatgccaccatgcttgactaattttaaaaaaaattttttttttttgtaaagatagggtctcactttttttgctcaagctggtcttgaacttgggctcaagtgatcctcccatctcagcctcccaaagtgccaggattacaggcacaagccgctgtgctcagcgaggtgcagtaacttgactgaagtcacaaggtgctggtgaggctgggacttccagcaggaactcagcctcaggtggaaagaccccagggtctgtgctctgaggcctctcccatgcactgtggtgctcaggacagaggcttggatggattgagtgagtgaatgaatgactttggcagggggtgggtgaagagactcctgtccccccagccctgcctcctgaccatgtcctctctcctccccacagccgtcaagggattctgggccacccgcccttccttctccaccttctacttcgtctttgccatttttgtggtgtccaccatctttcactgccaccagcacctggctctggtgcctgcgccctgggcatactcagcccgtgtggtcctggcccccagacacctgccccgggaggacctgttcactatcaactccaagggccgcctggggaaccagatgggcgagtacgccacgctgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggagtaccgccacatcccggggcgctgtgtccgcctcacgggctacccctgctcctggaccttctaccaccacctccgccaggagatcctccaggagttcaccctgcacgaccacgtgcgcgaggaggcccagaagttcctgcggggcctgcaggccaagtgggcagggcaggcgaccttcgtgggggtccacgtgcgccggggggactatgtccgtgtcatgccgcgcgtatggaagggggtgctggccgaccggctacctgcagcgggccctggactggttccgggcctgctgccgcctcccggtctttgtggtcaccagcgatgacatggcctggtgccgggagagcatcaacagctcccttggggacgtggtgttcgctggcaatggcctccagggctcacctgccaaggacttcgcactgctcacacagtgcaaccacaccatcatcaccgtgggcaccttcggggtctgggccgcgtacctcgcgggcggggacactgtctacctggccaacttcaccctgcccaactcccctttcaacgtggtctttaggccgtaagcggccttcctgccagagtgggtgggccttgcggctgaccttggacaggctggacagaacggcctctagccagccctgcatgtgcctggtcctcatcctgtgacccgaggggcagtgagtggggcgtgcggggcatggactcacggtccctcatgcagtttggatccaggcttatctacttcatagctgagtgagtttggacaactgactcaacctctgtgccttagtatgtcaaccacaaaatgcacaaaccacagaactaaacaccagtagcagctggtgggagctgagcaaattcgcttagagccagtgccttgtgaccgtgtgggaggtgtcggctgctcacatgtatgcagcacgtcaggaacactggcattgctttccaatggaaacgcagttttgccctctccttcctggcagcactggtagcacagagcccagatattttgcactcacgtcccaggacgaagccatccctgccctgaaggataggggaactcgattttctgggcaactaggaattttggctttggagttagtgggccttatcacaaaagaatgtgagggaagggccgggtgcggtggcacgcctgtaatcccagccctttgggaagccaaggctggtggatcacttgaggtcaggagttcgagaccagcctggccaacatggcgaaacccagtctctactaaaaatacaaaaagccaggcacggtggtgcgtgcccctaatcccagctactccggaggctgaagcaggaggatagcttgaattgggaagcagaggttgcagtaaaccgagatcataccactgcactccagcctgggccacagagcgagactccatcgcaaaaaaaaaaaaaaaaatagaattccagggaagacaggatttgcagggacacacctatgaggagggattcccctgcgatggacaggggaggggtttaggtgcaggtagcaccctgggcgcagggaagaaggcgtcacagtgagggcagaaaagacactcctcagatcctggaagcagcaacctgacccccaggggccactaagaccaaatcatggccatctcagcagcagcgtgtgtgacagttactggaaaaagatacctcacacctggcactgcctaacccccgagaacctaatgccactctgagaaagctcagtacgggtgcaagttggattaagtaattgcagtgcgagttttcctgtgttttattggtgtaatgctccttttggacattaaaaaaacttgacatatacaatgatcatttacatgcattaaacatttccaccaaatgtaggtgcagtggtttagaaaacattccaatcacatctctttcccatttgaaaccttttcaaggttgggtgcagtggctcatttctgtaatcccaacactttgagagctgagttggagggggatcccttgagcccaggagttcgagaccagcctgggaaacatattgaaacctcatctctacaaaaattagctgtgcctggtggcacacacccatggtcccagataatcaggaggctgaggtgggaggatcacctgagcttgggaggttgaggctgcagtgagccatgatcacaccactgtactccagcctgggcaacagaataagaccctgtctcaataaaattaaataaataaataaataaattgcttgcagctggtgccaaggaatggtagtctcccagtagacagaaaacacccgaagctggccaggtgtggtggctcacgcctataatcccagcacttgggggcccgaggtgggcggatcacctgaggtcaggagttcaagaccagcctggccaacgtggcgaaaccctgtctctaataaaaatacaaaaattaggccgggcacggtggctcatgcctgtaatcgagcactttgggaagccgagcctggcggatcacgaattcaggagatcgagaccatcctggctaacaaggtgaaaccccgtctctactaaaaaaaagaaaaaatacaaaaaaattagccgggcgtggtggcgggcgggctcctgtagtcccagctactcgggaggctgaggcaggagaatggcgtgaacccgggaggcagagcttgcagtgagcagagatcgcgccagtgcactccagcctgggcgacagagtgagactccgtctcaaaaaaaaaaaaaattagccggtgtggtgatgcgcgcctgtaatcccagctatttgggaggctgaggcaggagaatcgcttgaacctgggaggtggaggttgcagcgagctgagatcgcgccattgcactccagcctgggcaacaagagagaaactccatctcaaaaaaagaaaaagaaaagaaaacacccgaagctggtgatcagcagcttcccaataagatcttgggagttcggcgagtgggcacaagcatgtgcactaagaggcaaaatagcagagtttaattggtacatgacctcctggggacattcagtgggtaagggaagaacgcttcaagtgagcacgcgtataacttcagtaaacacactgcgcatgctccccacccaggcgctggtaggccaccgcctaagtgaacagcccaccccaagggaggaactggggagaagggacgcaagaccccagaagtgtgccaacatataaaaccccaactcaaaaggtcaaactgcacacttgtctttcatgtcgcccgcttagccctcttccaagtgtactttcattccttttgtccctgctctaaagcttttcaataaactttctctcctgctctaaatgagagcctattgcccaggctgccttggtctttccttctgcctattcccctcagtcgaattctttcttcttaggagacaagaattgaggttgctgcagacccacacggatttgctgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaactcagggagggagggctgagtgcgatggctctttcgcccaggctggaagtgcagtggcgccatctcagctcactgcaacctccgcctcctgggttcaagcagtcctcccacctcagcctcccaagtgggattttaggcacccgctgccacatccagctgatttttgtatttttagtagagatggggttttgccattttggccaggctggtctgaccgcaagtgatccttccacctcggcctcccaaacttctgggatgacaggcgtgagccactgtgcccagccaacagctttcacattacaaaagcccaagcagaagctggcaagctgccaacaagctgcactaattcatcaataaatatttactgagtttcttactgcatttgcaaattccaaagcagaagttggacagacacctaaaagcccgccctgtccctcaccagaaggggacaaaaggaagctgagcaggacaggggccacttaagtcccctaaagaaggggattgcataccccagcacctcagacagtatccagtgcacagcacatgttccttatggtttgacttgtgacgagtccccggccaagtttccttgtttcatttttttgagacagagactctctctgtcacccaggctagagagcagtggtgcgatctcagcccactgcaacctccgcctcccaggttcaagtgattctcttgcctcagcttcctgagtagcttggactacaggcacctgccaccactccctgctaatttttgtatttttagtagagatggggtctcaccatgttggccaggctggtcttgaactcctgaccataggttatcctcctgcctcagcctcccaaagtgctgggattacaggcgtgagtcactgcacccagcctcccttggccaagttcatatattaaagtcctagccccaagtaggacctcagtccgtcacccaggctggagtgcagtggcacaatctcggttcactgcaacctccgcctcccaggttcaagtgattctcctgcctcagcctcctgagtagctgagataacaggagcacaccaccatgcctggctaattttttgtatgttcagtagagatggggtttcaccatgttgtccaggctggtctggaactcctgacctcaagtgatccgcccacctcggcctcccaaattgcggggattacaggcatgagccaccgtgcccagccctggtcagtcttgaggtctgtgttgatgttaaacactggtcagctgagcctgaattacaatggcaggagggtataatgaggcatgtccagccacccagtcccatcctgggctgaactagtgtttcaggtttactttagaatgcccttggtctagagggagggtccattcagttacctgggggactgagaattttatttgtggtttacagtaagataattgtaggtgtaactggttaagtccaggttatactggagtagggtgtgtggtgtccctaatccgttatgacgggtgaccacacagacaccaaagaaaggaaagccacatgatgacaaaggcagagattaactctgggcctccagaactaagggagaacgggctgggcgtgatgactcacacctgtaattccagcactttgggaggccgaggcaggtgggtcacctgaggtcagaagtttgaggccagcctgcctaacatggcgaaaccccatctctactaaaaacacaaaaattagccgggcgtgatggtgtatgcctgtaaccgcagctgcttgggaggctgaggtgggagaattgcttaaacaggaggcggaggctgcagtgagccaagatcactccaacctgggagacagagtgagaccctgtctcaaaaaaaaaaaaaaaaaaagaaaaaagaaaaactaaaggagaatgattttcttttgctttgagggacccagttgtgtgttaccttcttagagcaaccggggaaacacatagaacgtctaatgcatattaattgaatggattgtacaaacagagcgaaaagagaaccccatggcttagcaggaaagcagcttagagatgaaaggtttcagtgtccttggcacagggctagtagtcctggagatgatttcatggacactgtcccaggaagtaaaattctggaaatactttcattcattcaacaatatggtcatgggtcacttaacaatagggatgtgttctgagaaatgtattattaggcaatttcatgttgtatgaacatcatagagtatatttacacaaacccagatggggtgtgtgtgtgtatatatatattaaattcattttttttaatatggaaaacgaaatctccgagcaccattattgaatatcagtcatctcctgtacttcatctgcaatgccaatacaaagtgccagagatgaggtttctatatatgctctattataatattttattcgtttatttttgagacacagtctcgctctgtcacccaggttggtgtgcagtggtgcaaacacaactcactgcaacctctgcctcccgggctcaagtgctcctcctgcctcagcctcccgagtagctgggaccacaggcactcactgccacacttggctaatttttgtatattttttttaaagatggggtctcactatgttgcccaggctggtcttgaactcctgggtttaagggatcctcttgcctcagcctcccaaagtgctgagttataggcgtgagccaccgcacccagcctatttatttatttttgagacagagtcttgctctgtcacccaagctggactgcagtggctcgatctcagctcaccgcaacctctgcctcctgggctcaagagattcttgtgcctcagccatctgagtagctgggatttacaggcgtgctccaccatgcctggctaatttttgtatttttagtagagatggggttcaccatgtttcccaggctagtctcaaattcctggcctcaagtgatccaccctcctctgcctcccaaagcgctgggatgacaggcgtaagccaccgggcccagccaaattttaaagaaaacaggatatcaatttatatctcaaggcaaagagaaagaatgtaagttcttttgttgtttttgagattggttctccctctgttgcccagtctgatctcaaacacctgacctcaagagatcctcccacctccagcccccaaagtgttgcgattgtaggcgtgctggcctactttctgttctggttttctttcttttcttttctttttttccttttttttgagacagtttcactctttttgcccaggctggagtgcaatggcacgatctcggctcaccaccacctccgcctcccgggttcaggtgattctcctgcctcagcctcctgagtagctgggattacaatcacccaccaccatgcccggctaattttgcatttttagtagagatggggtggtgggggggcagggggtgtttctccatgttggtcaggctggtctggaactcccgaactcagatgatccgcccgcctcggtctcccaaagtgctgcgattacaggtgtgagccaccgctcccggccctactttctgttttttaactggattactgagtccatttacagataaagccgagaaagcacgtggagtttccaggactggcctaagcctcacctatagaaaaagcaggcacagctggaaggcagagctcttggatcccagaaatcacggatcccattcctaggctgaatccctgatcccctagaccagtggcaaagcccaagagggaaatgcccagggacaggctgttaaaagctcccacactcagcctgggctgcaaggcacactttactgtcagttctgcttggctcagtcagaaatctgagttttttcttatctcaatgcatgaagaaatgaggaggataaaatttgcccactgtggtaataaccattcattccaaccttgtcagttatcttcaaaattgtagctattgacagtaactacttagttatcccatgaccaaaggtcaagtgttttcttaccttagaaagtaaccctcctgggcccggtgtggtggctcacgtctgtaatcccagcactttgggagaccaaggcgggtggatcacctgaggtcgggagttcagaaccagcctgaccaacatggagaaaccccgtctctactaaaaatacaaaattagccgggcgtggtggcacatgcctgtaatcctaactactcggtgggctgaggcaggagaatcgcttgaacccgggaggcggaggttgtagtgagccgagattgtgccattgcactccagcctgggcaacaagagcaagactctctctcaaaaaaaaagagaagaaagtaacccttggaccttcaaaagccaaagagatcagggagtttagtgcaaaagagagcagaggattagaccccaccctcgactcttggggctccgtgaggaagacagaagaccccaaaaaggaagtctgtggtgctttggctgagctcctcaaggaggctcagaatcactaaaagtctcttttttattttatatatattttttattattatactttaagttctagggtacatgtgcacaacgtgcaggtttgttacatatgcatacatgtgccatgttggtgtgctgcacccattaactcgtctcttttaaatctcttcatgtgctattgaaggagacaaaaggaagaaagagtggaggtagatggggaaacaagtcttttttttctttttttgagacaaggtcttgctctgtcgctcaggctggagtgcagtgccaccatcgtgactcactgcagcctctatctcctgggctcaagtgatcttcccacctcagcctccaaagtagctgggaccacaggcatacaccaccatgcccggctattttccacatttttagaaggcttggcgtggtggctcatgcctgtaatcccagcactttgggaggccaggacaggtggatcacctgagatcagcctgaccaacttggtgaaacccccgtctctactaaaaatgcaaaaattagccgggcgtggtggcgcacgcctgtaatcccagctactcgggaggctgaggcaggagaatcgctagaacctgggtggcagaggttgcagtgagccgagattgtgccattgtactccagcctgggcaacaagagggaaactctgtcttggaataaataaataaataaaaataaataaaataataataaataaaattttggcagagatggctcttgctgtgttgtccagggtgctcttgaactcctggcctcaagcgatccttcagcctcagcctcccacagtgctgggattacaggcatgagtcaccacactcggcccatcaatttattttataagcaaactggttcacatacgttttttcccgttaatccagttttggaaagggaaaaaaaccaagacttttaccacctttactggaccgggtcccacaggcagagatccaaggagctggtaagaaatctcacctttttctgccagctatttatcatttgtcccagaaaaccatctgtaggctccgaaacaagagtgatttgatttgcatcctgctcacagtgccagaactgcggggaagttaaaatgtttcccctggaggttaaaacatttgagtctatataaatcaaactaataatagccagatagcaggagaaaggaatacacattttatcatgtgcacacaggactcacagaaaatacgcaaactcagagaaagggccagatagctgaagttgttttttgagacagagtttcactcttgttccccaggctggagtgcaatggtgcgatctcggctcaccacaacccctgcctcccgggttcaagcgattctccctcctcagcctcctgaatagctgagattacaggcatgcgccaccatgcccggctaattttgtatttttagtagagatgggatttctccatgttggtcaggctggtttcgaactgccgacctcaagtgatccgcccgcctcagcctcccaaagtgctgggattacaggcgtgagccaccgtgcctggctgagccaccgtgcccgacgaagtttttatatcactctgaggttaaagaagaatcaggacttggagactggtgagacaggttatggaagagagagaagaaaggcctggctacggagggctgtcttttaatgcagatgaaaccctgatgggtaggggctctcagaaagaataaactttcttttctttttatttgagatggagtttccctcctgttgcccaagctgaagtacagtggcatgatttcagctcactgcagccacccctcctgagttcaagcgattctcctgcttcaccctcccaagcagctggtattacaggcgcatgccaccaagctcggttacttttttgtatttttagtggaagacagtttcaccacgttagccaggctggtcttgaactcctgacctcaggtgatccgcctgcctcggcctcccaaagtgctgggattacaggcatgagccaccgtgccaggcctttaaaaacattttttttgagaccgagtcttgccctgtcacccaggctggagtgcagtggtgcgatctcagctcactgcaacctctgcctcctgggctcaagtgattctcattcctcagccttctgaatagatgggattacagatgtgcaccaccatgcccagctaatttttgcattttttgtaggcacagggttttactatgttgcccaggctgctctcgaacttcagccctcacatgattcacctgcctcggcctcccaaagtgctgtgattataggcgtgagccacctcaccccgcccgtccagaaagagtaaatttctttcttttttctttttcttttttttttttttttttttgagacaagtctcgctctgtagcccaggctggagtgcaagtggctcgatcttggctcactgcaagctctacctcccgggttcacaccattcttctgcctaagcctcctgagtaggtgggactacaggcgcccaccaccacgcctggctactttttgtagttttagtagagacggggtttcaccatgttagccaggatggtctcgatctcctgacttcataatctgcccacctcggcctcccaaagtgctgggattacaggcatgagccactgtgcccggcctacaattttttttctttttgagacggagtctcgctctgtcgcccaggctggagtgcagtggcgtgatctcagctcactgaaagctctgcctcccgggttcacgccattctcctgcctcagcctcccgagtagctgggactacaggtgcccgccaccatgcccagctaatttaaaaaaattttttttaaatttttagtagagatgggggtttcaccatgttagccacgacggtctcgatctcttgacctcatgatccgcccacctcagcctcccaaagtgctgggtgggattataggcgtgagccaccgtgcccggcctttttttcgttttgttttttgagatggagtctcaccctgtcacccaggctggagtgcaatggcacgatattggctcagtgcaacctctgcctcccaggttcaagcaattctgcttcagcctcccgagtagctgggattacaggcacagccaccatgcccggctaattttttgtatctagtagagacaggatttcaccagggttggccaggctgttctcaaactcctgacctcatgatcagcccgccaccctctcaaagtgctgggattacaggtgtgagccactgcacctaatctaatcttttataactgtcaatctaatcttataactgtatgttagcctttgtatgcaaaatgctgtcattctgctcacgatctccattttttgttgttgttgttgttggttttttgtttgttttgtttgtttgtttgttttagacagagtcttgctcttttgcccaggctggagtgcagtggtgcgatctcggaacactgaaacctccaccccaccccgcctctgcctcccaggttcaagcaattcttctgcctcagcctcccaggtagctgagattacaggtgctcaccaccacacagccagctaatttttgtatttttttttttttagtagagacagggcttcactatgttgaccaggctggtctcaaactcgtgacctcaaacgatctacctgccttggcctcccaaagtgctgggattacaggcattagccactgcgtttgacctctccatttttacctgtataaatgagttccacttttccccatactggaagcactgatcaccattcttcggtgtccttgtgtccctggacagccaccctcacacacttgtgtttaaaaaaacttttcttatttttttcttgagatggagtctcgttctgtcacccaggctggagtgcagtggcgtgatctcagctcactgcaacctccacctcccaggttcaagcaattctcatgcctcagcttcccgagtagctgggactacaggtgtgcaccaccacacccaggtaatttttgtatttttagtagagactgggttacagcatgttagccaggctggtctcgaactcccggtctcaagcaatctgcctgcctcagcttcccaaagtgctgagattacaggcgtgaacaactgtgcccagatttattttttaatttttcagaggcagggtctttctctgtcactcaggctggagtgcagcgtcaggatcatagctgacgctggacctcctgggctcctcttgcctcagcctctcaagtagctgggactacagacatgtgccaccatgtctggctaattttctttattttttgtagagagacaaggtcttgctatgttgcccaggctggtctttaacttctggcttcaagctatgctcctgcctcagcctcctgagtagctgagattacaggtgcatgcctccatgcctggccaccacggccaatttcaagctaccaatatgagatcattgaacatgcaattggaaagaaatgcacagtattacattgttctatagcaagcctattacacagacataataaatgtaaataggccaggcaagatggttcatacctgtaatcccagcactttgggaggctgaggcaggaggatcgctttgagctcaggagttcgaggccagcctgggtaacatagtgagaccccatctctacaaaaaaacacaaaattaactgagtgtggtgacgggcacctgtagtcccagctactcaggaggccaaggcaggagactcatttgagcccaggaggcggaggttgcagtgagcacatacattgattggcacacagattggcagatactaacatacagtgtgtttttttctccagagaactggctggtaagtgtttaccatagtaagaagacttactatagaacaatgtattactgtgcgtttctttccaattccatgttcaatgatctcttattggtagcttgaaattggccgtggtggccaagcatgggggcgtgcaccagtaagggaaagctgaaatggaaaacagagggtttagggcaacagtcctgaattccggagtgctgtccccctgggggagttatgggaatctgtgggggttgtttttagttgtcacagtggaggtcctaggatgctaccacagcgtttacgcggctggggtcagcgacaataaaagttacgcaatgaaggtttgtcctgcattctcaggactttgttttatttttgagacagagtcttgctctgtcacccaggctggagtgcagtggtaccatctcggctcactgcaacctctgcctcccaggttcaaggaattctcctcccctagcctcctgagtagctgggattacaggcgtgcaccaccatgcccagctaattttgtatttttagtagagatggagtttcactaaaaaaaaatgttggctaggctggtctcaaactcctgacctcaggtgatcctcctgcctcggcctcccaaagtgctgggattgcaggcatgagccactgcgcccaggtcattcccatgactttggaacatctgtgggacattcatggagttggaaagtctaagcctctgagccccaaatctgttttgcgttttttttttttttttttttttgagagggagtcttgctctgtcgcccaggctggagtgcagtggtgtgacctcggctcactgcaagctccgcccccggggttcacgccattctcctgcctcagcctcccaagtagctgggactacaggcacccaccaccacgcccggctaattttttttttatatatatttttagtagagacggggtttcactgtattagccaggatggtctcaatctcctgacctcgtgatccgcccgactcagcctcccaaagtgctgggattacaggcgtgagccaccacacctggcctgttttgcatattttatgacagctcacctccccacttccccgccccaccctgtttcttttttccttgtcgctgaatcacagggaaacaggtcgtttgtcctgtggacgggctcacattctggactgggctgattgctgcctcatggtgtcgtttcactgggaactttgtcctcctgttttctgcaaactggtggttagagtgggaagcttgatctgatttttttgtttgtttgtttgaagggagctccgtagctggtaggtagcctcctgctgcttagctgaagctggggagtggctgctggtttctctttcctcctgttaggactgctgggagctctggtggtgcctgcctcttctctcagtaaaattcctcatccatcttttttttttttgagacagagttttgctcttgtttcccaggctggagtgcaatggtgtaatctcagtttactgcaacctccgcctcccaagttcaagcgattctcctgcctcagcctcccaagtagctgggattacaggtgcatgccaccacgccccactgatttttgcatttttagtagagacagggtttcaccatgttggccagactggtctcaaactcctgacctcaggtgatccacctgcctcggcctcccaaagtgctgggattacaggcatgagccactgtgctgggccatggctaatttctgtattcttataaggacggggtttcaccttgttggccaggctggtctctgactcctgacctcagttgatccgcctgcctcggcctcccaaagtgctagaattacaggtgtgagtcaccacaccgggcccatttgtatttaaaaatttttttgaaataggcagggcgaggtggctcacgtctgtaatcccagcactttgggaagctgaggcaggagaatcccttgaacttgtgaggcggcggttgcagtgagctgagatcacgccattgcactccagcctgggcaacaagagcaaaactctctcaaaaagtaatactactaataattaattaataaataaatataagactctgaggggactcagagtcagcgagagcctggcctagcaggactctgtcccccgcctccatgctgccttcctggaggccttcctggctgcctggaggagcggagcagagtgggggcccctttctgttggggcatcacaacagttccccaaggaagaccctcggggacccggatgggggatgcgaccttgtcctgcctctctcccccacccttatggccaggcttggggtgcctggtgcaggtggaggagctaagggtagataacaagatggactttgtggccggcaatggggagggaggaggggctacgggctcacctccctcccgcagcccagccacacctgctctggaaagccctgtagctcctgggcggggtttgccagtcaccgatgctggaagggtttctttggccctgagtgaagagagacccagagggaacactgaggtgcctgcccaaccactctgtcccggtttccttcagcaggaccaggtgagagaaggtgagggggctcctctcccaccctacaacacgcacacctctgcacacacgcccaggcggagagcagggatttgggacgtggacctgtgtgccctcgtgggtccctggtgccctctgggaggcacccccaactcaggacctccaggagaggagggtccctccctcggcagccaggacccccctccccagccagccgccctccttagctccctccccacttccttccaggtggatctgtttctagagctccaaccaccagctccctccccttctccaccccgggccaccaggtccttccttgtctccttcccctcagcagtttctatgaaccaccctggcagtaatggtgcagatggctcgcgcacagctggtggtgacccgactttcctgcctccaccctggggctcctcagaggcttcatggaacccaaactgctggtctcacctccgagccctgccctcgcccagggagggcggctccgtccctcctgcactccctaatcccgctctgaatcaccgcttctgttctgggtcggagaataaaggtggggtttccaagtgatggccctacgttattgtctgaagctcccttctcctccccagggtggaagtgataatgccgggaatccgggaatcccggggaggtgcaggaagacagcgagctcgaggcagtggggtgcgactgagccggatgtgctgagctgcccggggcacggggcggttggggtagagaaaggctttcagagctgggggacaggacggggccccgggtgagcggagagctgggttatttcacgggaacagctggtgacaaagccggaggggtgtgcggggccggcgagagactgggattgtgtcttaagaggcatagggagccctgaaggggctgcgagctgggaaggggcagggccggcgctgggtgtaggggacagaggggagaggaggaagccgggccgcaatagaaagacgtggacggggctggacgtggtggctgacgcctgtaatcccagcactttgggaggccgagacaggcggatcacttgaggtcaggagttcgagaccagtctggccaacatggagaaaccccgtctctactaaaaatacaaaattagccaggcgtggtggtgcatgcctgtaatcccagctactcgggaggctgaggcaggagaatcgtttgaacccgggaggcggaggttgtggtgagccgagattgtgccattgcactccagcctggggaacaagagcaaaactccgtctcaaaaaaaaaaaaaaaaaaaaaaaatctcagtaagatagaccaggtgtggtgtctcatgcctgtaatcccagcactttgggaggctgaggaaggagaacagaggacctcctgaggccaggagtttgagatcagtgtgggccacatagcaagaccccctccccaccatccctacaaaaaaagcaattcaaaaaaaataatgccttcaggcagaatgggagtggtgcttggttcaagcctgacataagtgtgagtttggggcacaaattctgctctgaataccagggacagcccatgtaatacagcatttccctttgtgcccacgcagccctaagggaggtgtggtttgttgttgttgttgtatctttttgagatggatttttgctcttgttgcccaggctggcatgcaatggtacaatctcggctcactgcaacctccgcctcccaggttcaagcgattctccttcctcagcctcccaagtagctgagattacagtcatgagccaccatgcctggctaattttttgtatttagtagaaatggggtttcaccatattagtcaggctggtctcgaactcctgacctcaggtgatccacccgcctcagcctaccaaagtgttgggattacaggcatgagccactgcactggctcttttttttttttttttttttttttgagacggagtctcactgtgttgtgcaggctggagtgcaatggtgtgatctcagctcactgaaacctctggggaggtgttgtttttatccctccccacaaccccctgttgatggacagacaaggacaatgaaacacagagaggtaaaagccctgggttaaagtcacacagcacataaaaggttcctgatcatgccgtgcagggcatctcgccaaacctcaaaaattcacaatctcatagcgcagcttgctctgtgaggcctccccacctcttccttctctccttccaggctccagtcaaggtcagtgcccagcttcctgctctgggccactcagcagccaccttcctccttcctgggtaaggaggtagggagctaccaaggaggcagggacatccgtgtagaacattctgcttttcttttttctttttttttaagatagagcctgactctgtcgcccaggctggagtgcagctgtagtgtaatggcacaatcgcagctcaccacaacctccatctcccaggttcaagtggttctcctgcctcagcctcctgagtagctgtgattacaggcatgtgccaccacgcctggctaatttttgtatttttagtagcgacggggtttctccatgttggtcaggctgctttcaaactcctgacctcaggtgatccgcccccgcttggcctcccaaagtgctggaattacaggcgtgagccactgcgcctggcctaattttctctaaaatagagacaagttctcactatgtggtccaggctgatctcgaactcctgaactcaagcaatcctcccagctcagcctcccaaagtgctagcattacatgtgtgagccatcatgcctggtccctgtctgtttcattctccctgtctctctagtcctgcctctctctgtgtcttctggtctttttctctatttgtctcttcctctgtcccttttatcatctctgtcccttccctccctccctccctcccttccttccttccttccttccataggtgagaaaaagtagcatcttttcctcacctatcacaaagtttgcagctggggcacctacagtaaaaggttaacagacacaagcataacaaatgtatttaaggcaagtgttgacatgggagccttcagaaatgaaggcctaaagaaacagggaaacctgggtgggttttttgttttgttttgtttttagatggagttttactctgtcgcccaggctggagtgcagtggcgcgatcttagcttactgactgcaatctctgccttccatgatcaagtgattctcctgcctcaacctccccagtagctgggattacaggtgcgcgccaccatgcccagctaatttttgtatttttagtagagaaggggtttcactatgttggccagactggtctcgaactgctgacctcaggtgatccacccactttggcttctggaagttctggcattacaggcgtgagccactgtgcccggctacctcccgttctatgatctatggtttaaacgctacatttgaccactatcaatactcccagtatcaaaactgggaaacctgggttcttcacccagagcctaaaacgaacagcattctttgccttgtgggtgacaatagcaaacatttaccgcctgtgtatatgtgccagacactgttttaatcctcagagaggtgatgtcacttgcccaaaatcacacagctcgtgactgtgagtctgaaattggccagagcttgtgcacctagccactggtggtgatgtgtctttgagtcatcgagtccagcattctgtgttggacttagtgaaaggatatacttttgtagtgatgagaaaggagctttatctagaatttgtgaggccaggcatggtggctcacgcctgtaatcccagcactttgggaggctgaggtgggtggatcacttgaggtcaggagtttgagaccagcctggtcaacatggtaaaaccccgtccgactaaaaatacaaaaattagccaggtgtggtggtgcacacctgtaatcccagctactcaggaggctgaggcaagagaattgcttgaacccaggaggcggaggttgcagtaagccaagatggcgccactgcactccagcctgggtgacagagcaagactccatctcaaaaaaaaaaaaaaaaaaaaaagaaaaggaaaagaagtgaactggttcaaagaccataatcatacatatcacacaagactgcaagcggaccagggtcagttaatttagcggctccacaaagtcatcagtcacctgagctccatccatcttcacatgctgtgctaccatttattttattttatttttttttttgagacggagtctcgctctgtctcccaggctggagtgcagtggcgcgatctcggctcaccgcaagttgcgcctcccaggttcatgccattctcctgcctcaacctcctgagtagctgggactataggcgcccaccaccacacccggctaatttttttatatatatttttagtagagacggggtttcaccgtgttagccaggatggtctcgatctcctgacctcatgatccgcccgccttggcctcccaaagtgctgggattacaggcgtgagccaccgcgcccagccagctaccatttcttagctgtatcatctcacggtcccaaaagggctgctacacatccagccatcacatgcagataatttctttcaaaaacagcagaaagaggctcgttcttgtcttggtcccttttgaagaatgaatgaaaccttcctaagccttccagcaactccccccacaactccgatgggtaggaattgtcacataaccatgtggcccgataggaggcaaaagaaatgagacttctgggattagtttagcctcagattctgcagctgagaagttgatcagccacctctgaaggacaagcagcttgcagaaaattagggtggtgttaccaaggagaaaaggggaaatggctttagagtagacaacagggatgccctgaggggttgtgtaggttgttcactgcacgaagtcccctggtcaagaaggtaagcggggtttaaacagacccacagtctactcatcaaaccaggtgtccttggcattgtgtccacccagagagctcactattttcttttcttttcttttctttttttgaaatggagtcttgctgtgtcccccaggctggagtgcagtggcatgatcttggctcactgcagcctccgcctcccgggttcaagcaattctcctgcctcagcctcccgagttcaagcaattctcctgcctcagcctcccgagtagctgggattacgggcgtccgccaccacacctggctaatttttgtatttttagtagagacagggccttgtcatgttggccaggttggtctccagctcctgacctcagctaatctgcccacctcggcctcccaaagtgctgggattacaggcgtgagccaccgcgcccggccacaactcatcttttagagccagcctacacttgtcataggccatggccgatgaatgggaagtccacggtggagctgggtgttcctctcaagttcaactggctgcggccaggagggcaggcaggccaggtggacaatttcccttcaaagtggatacaggcaggacatgcaaagatgaatatctctggcactggactctggcaagtaggaaaataaaaacaaaagatgaacatcttgggccgggcgcggtggctcacatctgtaatcccagcactttgcgaggctgaggcagaaagatcacgaggtcaggagttcgagactagcctgaccaacatggtgaaaccccgtctctactaaaaatacaaaagttagccaggcgtggtggcgggcgcctgtaatcccagctactcaggaggctgagacaggagtatagcttgaacctgggaggcagaggttgcagtgagcagagatcgtgccattgcactccagcctgggtgacagagattccatttcaaaaaaaaagaacatctctacaaactggatcaccagtaaataatagctacatatacttgtactcaccatatgtggacacccacatatgtacactcagtcgataaacacccacatttaaacataccatgtgggccaggtgcagtggctcacgcctataatctgagcactttgggaggccaaggtgggaagatcacttgggcctaggagtttgagaccagcctgaccaacatactgagaccttatctctacaaaagagaatttgtttttagttagctgggcgtggtgatgtgcacctgtagtcccaactactcgggaggctaaggcaggaggattgcttgagcctaggaggtcaaggctacagtgagccacgttctcaccactgcactccagcccaggtggcagagcaagatcctgtctcaaaaaataaataaaaaattaataaacaaaaaatgcatacaatgtatagatacacaaagtgtatatatatacatatatatgtatacacattcacatatacacacatgctgtgttcacaatcacctagatgacatatgtatgtgtatacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgggaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccccagtctactcatcaaaccaggtgtccttggcattgtgtccacccagagagctcatgttttcttttctttttctttttttttttttttttttttttttttttttttttgagatggagtcttgctgcatcccccaggctggagtgcagtggcatgatcttggctcactgcagcctccgcctcccaggttcaagcgattctcctgcctcagcctcccgagtagctgggattacaggtgcgtgccaccacgcccagctaatttttatacgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatgggagaaaaggttctctgagagcgtattac

SEQ ID NO: 14330 - DNA, 45833 bp, Human
tgtcaggcctggagctggggctgagcttggctccatctgaactgggggacagggggacgaggggtgggtagctccctaaagaaaatggggttggagagtgccaagctggctcaaaccctggctccttcctgtgcatcttgtcacctggcagctggcagggaggcaaatgcagaggtcagggctgggcttgtggggtacaggcgtggcaccggaagacctctaggatcctggtggcacacatggtgtggatacgctgctgctctgtcccagagtcccccagcattcctttgacatcatttattgcctggcataggtgcattcattcacgtttgtcaagcagcacctgtgtgctgtgttggcaagaagtctgcttagggaaacctggaagtctggttggagacccctctgacctcccctgctcccttgtagcccctgggtctcgcgcacgccactcactccagtgtttgccttggctgtacacggtgaatcagaccctggtgtgccgaggcttcggggagcatggtggggggaatgtcaccatcagtgggctgcctggctgtggactgatgccccaaggtcaagaccagagtctgtcctgcgtctgcaggagtgggatggtgtctgtttggtcatcttggtgctgtccctttctctccacctcagtcactacccacctggtctccccacagccactctcactcccttccccaaactgtttgctttcaacctaaaccaaccccaggcatccccttgccttttatgacatttccccagcaagtcagcatgcccaccgcctgcccctggccccatcaccccgcaagctgtgacttcaagctgctgctgctctcccttccagctcttcttgagaccccagcacagccccctcttctcagggacctcccctggactccagagcagaccaggtcaatgcccaagcagagtgccttcgtcgtgatcatgggcagcacatgcttcctgggtaatgcctggctccccacgaccggggtcggggggcctgcgaaggcagggctcttcccaaaccctgctcaacgcggaggcaccagtgcgcagcccgcagcccacagcaggcattcaccagagtcacagctgctcttgcttggcctccacgctaggccctcagtgccctgaatggtgaaagaggccctgggagcacccccagagttcatcaaagtgcatgcaggcccaaggccatgaggcaggtgtggtctgcgcctcctcgtggggtcgaggcagtcctcatctgtgcttcctgtgcgggcagcagggcctcctgggctgccacccactccggggctgagtggcacagggctgtggatctggctgcccctgggtaggagacagatggtgttgcgtgggcattacaggccgccttgctcttgtcccatcaagtgacagaacaccccagagtgtttcttccttcagccgctgtgcaagatggactctcaggcctctagcaactccagacatcctttcctcccaaccagcactcacttagagatccaggttgagcgttaggattcttctaccagaactgtctgcaaacagcgcgagcggtggcccttttttttgccctctggcctgtaaactttaaaaagctaaattagtctctaacatttgcaattcaggaggtgccacattcctgcaaggtcacagttcatggcgccaaatagcgctgccacactctccgctgctctcccactcccatttacacgcccgctctcagtgagtcttgaaaactccttattgatgataaatgcatacagcagagggcacacgtcacatcattctgggtgcatttcacaaacccagcacacctgtgcctccaggcatccgagtcaagacgctgttctaagtgatttgatgttctctggagttactagtttcatttatatatatgtttaacatattacaaacaagtgtagctttgtttactgtatgcatatagtgttggggggaaaaaaactaatttttctttttgcagaaaagcctgccattgctccgcccgtctttgtgtttcagaaggataaaggacaaaaggtaaggggccggtacgttctctcttcacttcgttactctaatttgttctctctttactgagagtctcttttccaggtcgcattgccaaggccacttctgcccacagacggggagacctaagcagaggcctttacactttcacgttgagcttggagggaaaaggcttggtggctttaggttaccgtggagagaggttaggatgggtctgttgtggaaagggctcagagagtacagtttgttgaaacagtattagaaagcttcttcctaattcctgatgatttgtttgagaaatgccactgtaccttaggaaaaccaacagcagagggacagtagggggcaaagggaggagggaaggtggggagggagtcagggagggagggagggaggggaaggaggagagcaatggtggttacaggggaaacaagacctttaagcctggatttattggccctaacgagctgggcgtacgtgcatttagagtaattgttcatttgtttgcattatatatttatcccgtgtccatgaggctgcttctcccttggattcagggtgtctgggtcgcagtgtggttggaagtacctcgcctgattcatggcgatgagctggcagcctgtggaaggtctgattggtgtggcaacagggttctgtgataagacaacgatgggtgctatttaccttgaagccatcggcttctctccctgacagatcggtgtggatggtcagagttttgtcagaagttagttggtgctgtgtggcagtgactcctcagcttgcatggggaccctcactgtttatccagaaataatgtgtggtccctccccactgatgcccagcgacggcactccccacctcatacccgctgcaacagtcccactgatgcccagcggcggcactccccacctcatacccgctgcagcagtcccactgatgcccagcggcggcactccccacctcatacccgctgcaacattttagagtgaccaagtgttgtgctgaattcggtgcattttgaggatgtctgcatcttgttggtaataacaggatttgagaatctcatcaactccattctcctgtggcttctgtcccctcacaggtgaccggctcccaggctggaagccgctctcatgatctgggactcagctgctggtcttaggtcctgtcccaaagccagcatttatcttgatgtggcccggttttcctgagcaatgttgaagtgctctgtggggatcgggtgtgtgtgtttgtaggggttggggaggaggggaaaatggttgttctaaacctcccccagcacacccctcccaggatacctgtgtgttagcctggacttatctactaagcttgtaactttaactcatgaaactttcccattgttactttttttgctgaagaagcaatccagaaacatgaaaactttcttctagttttgttttggttctccaggtatttccaagataaatctgcctctgctatctcctctcccttgggccctgacaagtacagcttaatgacgtggctttatgatttgtcttttggaggttccatcagtacgaaaggactggtgcatttctctagttttagagaatagtgaagcctcaggagttgggtgtgttagagctatgttggagatgttatagtcattcctcaggtgttcagtaaaatcaggattttctagaattttgcattttattatcttttgaaccatttttagtttaaaacaaaggttagcaaattaaggcacagcactgccacctgtgtttttttgttttgttttttgctgttgttttatttgtttatgtttttatctttgagagacggagcctcactctttggcctaggctggagtgcaggatcgtgatcataattcactgcagtcttgaactcctggcttcaagcaatctcccgcctcagccttctgagtagctgggactacaggcaccaccaccacacctggctaatttgaaaaaaaaaaattttttttagagatggtgtcttgctgtgttgcccaagctggtctcgaacttatggctttaatcatttctcctgcctcagcctcccaaagtgctgggattgtgggcatgagccaacaagaacagagccacaactatcccctttgcggttgcctgtggctgctacagcagtagtatttggacagagaccgtgtggcttgcagagccttaagatatttagtatctgaccctttgcagaaaacagtttgccaacccctggtttaaaacaaacaataggaatcagtaattctttaaatctgaagactttaaggcaaccagcaagatggaacagtaatgtgtaatatttgctcagatgaatttaaagtgcttttaaagtcactagctgctgtgtcagtactgttttcacagctgagggggttttgttgctttgtgatttgcaggctaatttgcatgtatgaccttcaaggggtctatgccaattacataaacatgttggagttgaaccagaaggctagccaggaaggcatttttaaaaatgcaagtaggccagacacggtggctcacacctgtaatcccagcactttgggaggccgaggtgggcagatcacaaggtcaggagttcaaccagcctgaccaacatggtgaaaccccatctctactgtggtggcagatgcctgtaatcccagctactcaggaggctgaggcaggagaatcgcttgaacccgggactggaggttacagtgagctgagatcgcaccactgcactccagcctgggcgacagagtgagactccatctcaaaaaaaattaaaaataaaaattaaaaataaaatgccaagtatagttcttatcaaaatattggctcacagccaattctaaatggacttctaaaaataactgccctccagccttgggagttgggctgcccacttctgtcactcgcacttctgtggcaccgtcgctgaagaggcatgtgggaaacctctgtgctgaggccaggagcaggaggagcgtgtttgcttcgctgtcggaggacagtgtccacatggccctagagtcctttctgccactggggagtgaggtggaaagtaaacacacagggcgggcggctggctttgtttctccttggctttctggttcagggcctgcagggagcagctgcagtgtgtgtcagaagtgagggtttgagagcctttatggtttcattctctcttgcggaggccatcaacccatccctgtcttgctctccagaagccgagctgggaccgagcttttagagctgctgccattgtttttccgaggaggttccccccgccccaccctttttgcttcaacattttattctgaaaattttcaaatccttggaaaagagtgacactgcaaacacttgggtatcctgcccctgccctctctgttagcattgctgccctcacctctcataccggaagttaagcccatgtgacatttctgccctaaattcttccacgggtgtctcatagggatgaggccattctcctgcatggccttaccaccatgttactcctacgaaaatgttaattcagtaatatcctccagtatatagtccatgttttaaattgtcctaattgcccctcagatgtcacttatagtgactttaacaacttcttgatcctcaaagatcaagaagtctcatcaactgtgggaccagctgacttacctttcagtaaacgagatctcagaccacacccgatggggtgcaagtaaaagagccccttcgtctccaccatccctctcacgccattcaaaggagacagctctgtatgctcaggttttattgctgaatcatgattcagcatgatttggagttgaaaagaaagacatgaagctgccagccgaggaattttttgtttttgttcagtggcaaagccacacagcggttttctgtgggtcccgttgatgtgtcagattgcacttcagcacactacggattgggaccgtggcctgcgtgtgggtgccggtggcatcacttagccttgggtgaggttgccaaatcctatcgttccaggatagaaaaagccatgtgtggttttaattgtagtcctagggcctaaaacgaagccatggtcagattggcagcacagggatgttactcccttcccatgcctgcgcttcctggggaggggcgtgctgtctcatcgaaacgcctgcgtttacatgcaccattgtttccggggcaaaaatgaaacctttctttcttaactgccttggatggagatagagttctttctttttctttttaatgtgaagagaatttaaatatccttatgtaggctgttccattctttgtaaagactaaacatttctttcagttgctctctctccagagcatttgttaatctgaagtggggaggctttgaggttgtactagcagaataatggccatttggtaaaaagaaggcagttacagaaatgctatttagcagaaagtacagtatcactgaaaatgtggtcgtagggtgtttagacctgcttttgaggcttaccgttggtgtgatgagcttagccctggtgcacgtggtttttgccagccatgtgtattttaggatgaggtcaaaggctggcaaactcttgatgtctgattttaccagacatgttgaaaaactccaggcttcaccttagttctttagagcttacgattcctgcccaggagaaatgctaggacctgagtagaaaatgctggaatgacattgttaattctcccatctgagagaggaagtgatgtaatacttctcaacacttatacaaatcattcatcttaaccaaagatgacgaatttgatcctgttttgatgtcttggtttccatgtttatgacttacttcttggtcctcctgtttagcattttgaattaccatgaggatgtttgaatatttacatttcaaaagcagggattacaaaaaattcaagtggttctaattagagataggcagtcccccacagagctctgggtttaatttttctcttgtgaggtgttaagtctctcaccatcaagtagcaacagacatgggtggctggacgaaccacggtgccctgtgcaggtttagagagccaggtttagagagcggctggtccgtggctctgccctggatacgaagaggcgacagtgtccccttgattacttttgagtgaagattgcttttgctttcctaggaatttgtgtacattctcttacatcctctttctgtagctcctttcctcctcccggatcactgctttttaagtagtgcccaaaccccgtctaaagaggtcagccacttcacacccaagaagaagcacagccacgtccacggggagacggggcagccctgtagtcatgtaggtcaccgagtgcgagaaatggctccatgtcgttggacgatgccaagagggaggtttggggactggagtctgttttaggacaccaggtgtttaacccatttctcaagaaaagtcttggagttacggccacagagctctcagcccatggaagccctgctggagtcccaggaaccaccttaaaggatgctgggtgttgtactgtggggaggaagacttctggaaccggctgctctcaccttggcagctttccaaatgagcccttgcctggggtgttgaggatgcacctgggagaatcctaggctgaggggctctgtggatttgcccccctccttcatctgaactacccgcctgccactgatgcaaaaaccagctctcagtgtccatgtcaccccacacttgcactcaccgaggtgggaaagcactttctggatcctgggtgtaagcagaacaaatggaaagtgctagaagaactgtagtgagaggcagaagcccttgaccccggcgagaggcagaagcccttgaccctggcctccctggtttctccctaactttggggttccagccacctccctctttcctaaagcacagaaatggtgctgatggccagctcccccacttcagtatttttgagatcctgaaggggttttaatattttgcatgatcgtccctgtcccttgatcaccaaggcccgtaagccaagtagctccttgccaggcagcccatagttttggaaacgagggtcctgcttctcatacactgtagagctccctgcaaagtcacatggcacctagtccactctcacttcccttccgtcagccggagagccggttttgttgagcagaacccagaagcaggtgcctgctctccccatcttcctcccaggcgcaggagctgctgcaagctgagccagctccagcctctgacccctgcccgcccttcctgctgtgtgatgcagcctttattcacattgaaggaaaattgtcttttttgctcccagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcaggggtaagtccacacctacccggcactcctaccgcccagggggagcccaacccagaccagccactttcccttcgggtccctcagatcctggccctagctaattgtaagcagctaatggtaacttaaaagatgacaaggatttcttccagctcgctttaattcatgctgctgaaaagtcagggaagatcgaatccccttttagccttttctaaattgccgtgggaatatatacccacagcaagaggtgaatcctgtttcccaaaaaagacacgaggggtcaggaggaattgagtcatgtgaagtagaaccttccaaacctaatttgaccccttcaccctccttccatttttccttcttgtttccctgaatgcgggcattcaagtttagcgtcttagaaacccaagaagctaaggcttcctttgatatctaggaagaggcactctccaacacagattgctttgcaagactgattgtgtttggactgtggttaaggcagtgaactgattgtcttcaatcaaagcaggaagaagaaaagactcttcctttgaacccagaaggaatcccctgagccctttatctttgtattaagaagccttttgaagattataggtggagaagattgtgaactctcaagaacaagaaatgtcttgggtttttgaagtttgataaattgggaaaggtaaacattatcctacattcaggattgaaaactccatcctgtaggtaactcatgacagaagacccctattctcaggacagggaaaaaggactcttaacaagaaaagaagggacccagctctaccgcctgagcaccaggcagccttccaggctggtacggtcccaaaccttatcccggacctcagcgttctttctagcacacaacagtccccggtttttaaggaaactgttaacattcagctacagccaccaaacctcaggacacttaggaagcactgttcagccaggggtgggttggagtcctgtgttaacattttggaggagtcagtgtgtgatggaaaaagaagcaacagtctttacttgtgccataggctatgggtgtgggggaggtaacggcagtagtggccttcgtggcacaaaagtgggtttggggtagtgagacacgggagccgcgggaaggagtccagccaggaggcacttgacccacagtgcactgggagtacagccctcccatgagcgcacgtgactgccgccagagcaagaattaggaggtggctgcgtccttcttttgttggcagagtggctgccggaaacttctcctgagtcaggtatggtgagttactgcacctctggtctttgagagcacaggaaatggtgttctcaggtttccgtcttcagctgtctgggaacagatggtctttagggtcccccccagaggccttctgcaggtgcctgggtttgaaaaatgcagcccacataggactctccagctgcagaggtgacaggttctagaatgagagtagcaaacaagtgcatcacagagtttttgtgacagcaggtgctcttcaagagcacacgcgctgttctgtgccctgcgtacttctcacagaggcccatgttggagtgtctggaggggcctcacctcgtccacatgttcatctctttggcctggccagcccaggtagatctcagcatcctgattctcatggactttgggtctgaggctctgatcctgagaaattcaagcagtcccccacactggcaggtggaaggtgaagctgtatggcagggagccttgggatgagcttgtgggcaccgtgggagagccaggattggaggctgcatagagcagtatgtaaatgttccaatgtagctctggtggccatgtgcataacatgcaccttgtagttttagcactcgtaacttttggacacccactttcaggagccccaggagagccattgtcaagccccttgtgacagctctgagctgaccagggctcttccctcaggctgtctgcagagaacaccctgactggttgctaagggctcctgttaattggctttctctactaatcgggcctgctcagagcaaagtaaactttattttaggttagttaggccatagatcaagtcagatggaacccgatgccaactgcttcttggcctgagcctttttcgtgtgtgtgaactcagaccgttttcgtttgcatcagaagaaatttgggtctcactctgtatcacactggtgttcaggaaaccacccccatgttacccggcaggtctcatccatcacatctagtctgttcactttattccatggtccctggggggaatataaagctgagagttcttgatgataaacagtggtgcgctgaattgttacttgtaaagggcccttaccatcttttagtctcgtcagaaccctggccatggaagagtcagtaccaggaaaaagtctctatatatcagacttcctggctttcagaagacagtctgaagaagaccaaaccacatcccgattaagttctctgtttgatgtggagaaagcaggcagctctgggcactcactgcgagcctggtggaattgtactggactgaagctccctgccaaggacctgccgagcttcagatatgtttattagacccaccagggagcttaaggaggttctggaatgaatccctctggccagacagcttccccccaccttccagcccctgcacaggatttgaccctcagcacccctcaactttggaagccacctctcacttgcttttctcagggcctgcccttttgacaagaatttctgagctggttgcctctgccacagaataaaaagcattgaactggcccatcatttattttgtatcccaggtatccagccatgaccagccaggttttctaacttgccagactcactgaggccctggtacaccgcttggttgccagttttctagggggaatttatcttttttttttttttttgacatggagtctcgctctgtcgcccaggctggagtgcagtggcccgatctctgctcactgcaagctccgcctcctggggttcacgccgttctcctgcctcagcctcctgagtagctgggactgcaggcgcccgccaccatgcccagctaattttttttgtatttttggtagtgacagggtttcaccgtgttagccaggatggtctcaatctcctgaccttgtgatccgccgacctcggcctcccaaagtgctgggattacaggcgtgagccaccacgcccagccatctagagggaatttatctgacatggccttgctttctggcctttcctaggggaccaggtaaacagtgccattccttcctgcttcttccttgttcgtctttgtgtctgtggagtcggcttctgaaagctttgtccctttccctgggccgccttggcaccgaggacacaccagacagtctgacaagacccatgttttttggacagggcaattcttaataaatgtgacaaccatgattttcactgtttcattccttaggcaaagaacaagcttcccacccctgcattcccattccagatgggatgtgcccccctgtcttgtatttagtgacagggactcatgcgcctcacagaattgagttacttcccacaagctccctatggctgccggtggggagcttgttgcgccaccagcccccaccccgccggcagggacgtggggcacatgatcagcactcacagtgctcgctcccgaccagcctgcagcccaagccgcgggagggctgcttcatcttttctgagcctgctctgttcactcctgctgtcccagtgccagagagacaagtcaaagggccctctggtcttctttctcttctgcttccttattattactctgggatgttgtcatcatggtgttgaaatggatgctgacccagcattccccggtgtcatcctgaagccctgcgcctcgcagcagtagagtctagtttgggaaaagtggaggaggaggaggaaatggggctcttatgtcctgcttctgtcctcgctcctccccactaagctcgagtcttcggagcttgctctttttgtttttgtttctttcttttttcttttcttttctttctttttttttttttttgagacagagtctccctctgttgcccaggctgaagagcagtggcgccatctgggctcactgcaagctccacctcctgggttcaagcgattctcctgactcagcctcccgagtagctgggattacaggcatgcaccaccatgcctggctaatttttgtatttttagtagagacggggtttctccatgttggccaggctggtctcgaacccctgacctcaggtgatccacccgcccaggcctcccaaagtgctgggattacaggcatgagccaccgtgcccggcctggagcttgctcttaaaatcctcctgagctctggttgcagacctctgggggctgaccctgagtgtgtcccaggcattgttcgggaccaacccctgaggacccactgccttgtttggggtgaggggtggccccagactgccttgacaccaaacaggtccagactcctgggctgctgagtctaggaaatggaaaatgtggagctggcattggctgtgtgcagggctgggtggcttaaaggttccttcaccccaaaccatttcctgctttggagaaggcagcacaagccagctggacagcaagttccaacgtctcctgagaggagaggccctccatcccagcaaggtgcagggtgtggaggcctggattggggcagagggcaggcggcacctcacgtggccagcgggttaggattctagaagagctctgtccacaggcacgcgttctgtcttcttgcttccctccgctgggtcttagtggagagttgctggcaggaggttcccctgtcgaatcttcctgtgttgttcttcccaagccttggcttcccagcctttccaggaccaagaggccccccactttgttgcaggcaggctcttagaagatatttggggcacggatttgagggtctcctgagatcaggggtcaggcagcatctgaatcttgtctgcctaggcacccattcttctcaaggtcactgaaggggacatggtggaggacacggactccacccacgcagcaagtcctcagcaagtgccttctgtgcaggtgtcccgggtgtcgcgtgaatgaactgtgttgtaggagacacctctgagatcatttccctatgtgatagaacaaaacagggtagctcccgagaggggctgggatagggagtgagcatgaacttaccctagaggtggtgctcacagcatctcagacacgcagggacctggagggagggcgcccacggaggagcaacactcagtgaggcaggagcagccaacatgttcagaaaacaggaggccacatggccagagcctggtggcagaggggaccctgtgcctgaggaggccaccgaggcaggagggaaaggtacgttctcggggggctagagctaatgggacttgctggcaggttggaggtggtgggtgaaggggaggatgagtgcagaatgcctgggggcaccacagtgttcccggggctgcttctagagccacgagtagaccccaagagactgttgggagccccggagccacactcttgacctggacatgctgctctggggagagcatccatggcatccatgatccctgagaggcatgggtatcgtcaaaagagcccccaaaatacgcaaagcaaaaacggacagaactgaagggagaaatagtcgagtcaaccgtaagagttggaggcttcggtaccacactttgagtaatggatagaacatctagacaagatcagtaaggaaacaggacttcagcaacacaaaaaccaaccagacctaacagacatataggtcaccccacccaaacagtggggtacacagccttctcaagtgcacatggaaaattctccatggggggccatttgttaggtcaccaaacacatctcaaattttaaaggatcaaaatatggagtatgtgctccaaccacaaggagataaaattggaaatcaaaaacggaaactaggaaattgacacatgtggaaattaacctagataaccactgagccagagagttaggtgtggagatgtcaggagaaacatcccgtgcaggggtgaggagacacgagggagctcggggaccagttccttctgtaaggccggactcaggtcttcggcttctccgtggcctgcaaggggcctgggatgcagtgtcttttgttgaacaaatgctaaacgggcttctactgtgaggtccagttccttcctaagtctagtggagtccctgacacaactcccaggatcagaataagccacagagaaagagtataaggggcctggaggtcacctcaccaaggggttcattctcgcttgagggaaaaggagggcgtcactggatgagagagcaggtcgtctacagaggccagagagggtatggccatctcctggtcccagaagtcatttaggaagggacagatcccccaggaccagggaggacaccgtgtaagggttttggtacagttgaaaggctcgttggattaaaaggggagagaaaagtctagagccacaggatgggacttgggggtggggatgtcctgggcctgctgttaggaatggatgggaggactggtgaggccagggaagccagaggtgaggcgagcagtgcggtgtccgaggagatcgggctgtgcagaggctgctggcctcagacagtgacctgcacagagcatttggaggccaaagccagcctacagggctctggagggcatgggttacccagagggcaaggaggctgtgtcaggtgttgtttctcacagctgcctgtgctgggaggctgatgtaagggcccgtcgagggcagtagctgccccaggcatgagatgcccaggcttggctggatgagcaaaggttttggctgcccgggtgggcagatgctgcttctctgtacttctgtcacctttgctaagtatgagggcaagcgatagctggagcctgtacccaccccacagatgtcacccaagaaaagggatgacaaggtggtgacagctcagcactatcagatgcaaccccaggctctggcatttctagaaaggttcccagtccaggtccctcgcctcctggctgcacccaggactcactccacacccctgactccctattcatgcctgccttgagctctaaagccctgcccccagcgtagcctccagattttacatcggttgggagtttgatctcatcaggtgtgggtcacgagcattataatcatctgctcccagcgtgcagggcactgggctgagcaccttacctgccctgcctgtcacctcacgcatccctgttttccaggtgaggagaccgaaggctgggcaaggtaaggtttcacccgtagaaaatggcagagccggaatacactgagttcttccggccttcaagaggcagcagggaccaggcagcctctgcacccctcgtgcttttggcctggctggagttggtactgactctagggcctggctgcttgatggcattgcgttttggactcagtggtattttcacaattgccccagtgactaatagaacccactgttgtgttacaaggattttgtgtttcccacacactttgatgatgtcatctcgtggggatagtgataatcagccctcactcgtacagtcccttgggagcatttccaaagccccctcagaacacgggcctcaagcaagaagcccaggcttgcttttcccacacaaacccatgttgtcagctcacacgggaggagaaagtccagggtagctttttttctgaccgtcgtgaacgagctatgtgacttcaagtcaacttcctaccttctctgggctctcactgccacaagctccaggcctgggcctgtaagctaagatgatgtttacatttttaaaggattataaaagcaaaaacaagaatatatgacagagaccaaatgtggcccacaaagccagcagtaccgacagtctggccctttatgggaaaatgcatcgccctgacttgaggggggtctgccttggctcctgtgctcctcagttttatttattgcagtttgctttcccaggccactctgcagtttgcaaagcactttcacatgcatcacctcccctaagccccagcagctcgtcgaggcaggcgggcctcatttggctaaacttgacctctgaggagcattttagaaaataagaaaattggcttttctgcttgctcttgcagggagcgcgccaggaggagcggccctcactcatcggtgcgctttgggctgctaaattctgagacaggacataaatgagggattgtgttgggggagaggataaacactcctcatgttaagttttgagtttgtttgtgttttgagatgagatgtgtccttcaggctggggtgcagtggcatggtcatagctcactgcagcctcagaccccgggctcaggtgatcctcctgcctcagcctccctgggagctggggctacaggcattcacccccctgcccagctgatttttatgtggttgggttttttataaagacagagtctcaccatgtttcccaggctggtctcaaactcctgggctcaagcgatccttctgcctcagcttcccaaagtgctgggattacaggcatgagccactgcacccagtccattttaagtccttttgtttttttttttttttttttgagacagagtctcgctgtgtcgcccaggctggagtgcagtggtgtgatctcggctcactgcaagctccgcctaccgggctcaagcgattcttgtgcctcagcctgtagctgagattacaggcgtgcaccaccacgcccagctacttttttttgtatttttagtggagacagggtttcaccatgttggtcaggctggtcatgagcccattttaagtcttggttgctggttgttcacactctaaagctaaagtttgtggaatagggaattcttcaggagccttccctcagcctgtgactgggctttgtctttgatggttctgttctaaacacttcgcaagtgggctttggtccaaaacatccaagctcttgcttgctctgggaataacagccgaccctgagacaaggatgtgcatggtagaatgttccagggcaaggaagggaaatcgctcctatccggtgtgatgtgaccattttacacaagtccgctgccctcaagggtggagagggtcgcttttcagctcttggcagaatgaacgggggccagatgaggttcggctgtgtttgagtttaggggtggcaggccagttagcgtaacctgtggagaaacaagaaactgatctgggtgctgcggatgctttcccagccactgagaggattccttggcatgtgtttgtgaagctgggtgcagaggttcatcggggggatgtttgagctttaggctaaaatcctggctctcattcgggtgctgggctctgggaactagctgcccgtggtgcatgttgggatatttgttacggccccgagagttgctcggctgccgtgagcctgatgccctctgaccccggctgtgtgctccttgtttcagaggtcagctggcggctccagtcctgaaggcggagaaggtaaggagctctctaacacctttgaccatcttcagttttaaagacagaagcaacctgatttttctcctcctcttctcatcattttctgtagattctgacagagaagatggaaattactgccctcctgtcaagcgagaaagaacatcctctttaacccagttcccaccctcacagtcaggtaaaatatgcaaacttacggaatggtgaaagcgtttatgcttacaaacccgccattcccctcagtgccgcgcatccgtctgctgtgtccttcctgcccagctccggttagagtcgatctgaggctcgggctctgtcaggagtgaggtgagagcttgtccagagtgcagcatcaggggtcctcgtctcgaatcagtgacactgacggcatggtgagacttggtggcctgaggaagactgtgaagagatcgtccctctgaaatggaggaaaggggttgactactgagagccctgttggggcctctgcctgttaattacatctcctctttccaaggctggacacagactgggggtttaggggtggggtgttctcccaacccctcagctgcatgcccagcacgggcagtccagtgcagtagcccagacacacacacgcatgtacacacaagcatgcacacacacacggtaaccagcaagccaggaggccccagcagaggcccgtgtgtgatgctgtgaactcccagaggagaggagcttgcgggggcctggaagggtgggccaggctcggactgtggagcagggcaggctaaagggcttgaaggccctggacgtgaggcctggtctgagcacaggcctggaggtcggcctggggactcatgcaggctggtacaggagagaggttcctgaggcagataatgccgtcagcactacttaatataacactcagaaagcccggcctcctgccatgggcacaactctgcagatttgagggtaaatgccactgcagggctattctctcgtccccgtcttgacttcccactctggcattgtctcgtggcctctgtcttagctgtctgtagtgccaacttggacatacatgagtgtttagacaggttctctggttacccaactgaaatccattcctggaaagttcatgtaaatcattttacagtcctgaaccttcaggatgtcaagttgtttctgcttacagaagtcacgcatgcgttacaggaacacacagcgtaggaagccagggtccttcccaagtcacccctccacacccttgttttcatgcccttttcccatcacgttggttttggacatggccgcgtctttttgcacagctgcattaggttttccagtgctattacactgtcatctgctgactggatattgcggaactgtccagatggcttgcagtccaggctgcagttggcatccttttaatttaaggatctttgcacctgtggataggtgttctgtggaatgagggagctccacttcctgctcgttgattttattccttccccctcactgcccactgctgaaccatgcttgctgtatcgaaaaccagcatagagaagaggaggtgtttgggctgtgaatgtaggctaaagaggcgagggaccaccattcttctccccggccctcttcaaatcacctcccgtccagcgcagcagcccccaagagacactcagctctccagggtaactggaggcgtgaggggcaccaataatttgaacagtgttgtctttggttccattctgcgtagagtgagttcttcccctacgaattccacttcatttgtggaaacctgttggctggcccacaccctgggaagcagttgccctggtgaaggaagatcttaggtgggggagggggaaccccatggacaagccttgacaggtgaggaggagtcagggcctccaatgtggcctggagcatctgatatctcccctgccggctgcccctgcagaggtgcagggacaagggggtgcccccagttgaccagagttgactgtagtcatcagacagatcaaggccgtcgggctggagaccctcgtagtgctgtaaagagagtcttggggtttgctgttctcgggaaagactgaatgccctgtttgcgtgctgttccgtctcctcccgtgggacgtgagaatccacccctcaggtgggagaggtgatctctgagcgtccaccccacccattcatgctgtttttcctcttgttccctcccccgcctgcacctccttgtcaacagtttcaaaaaacaatgtttttatgccatcaagcttctgcgagccatctgcaggcaattccgactcagagccaagtgagccccggcccctctgccttcccgcccggcctgggggttctcctgggaggaaaagcaattggtgtgggaaaatcagatcttcagcgggcatttaaagtcagttcttcttcagctgttaaaatttttcccccaactcttcagctcatagtctggggatctggcgtgagatgaggcttcataagccctcatgtttgtttctgcaagcagggcctggttgcatggagctctaagtcctctaaaaacaacctgtgaagaaatgtatcactcatttttcaaaattttatacaagtaatgcattcataattggggttttttggttttttagacagactttcactctttttgcccaggctggagtgcagtggtgtgatctcaactcactgcaacctccgcctcccgggttcaagtgattctgctgcctcagcttcccgagtagctgggattacaggcgcacaccacaatgccggggtaattttgtatttttttagtagagacagggtttcacctgttggccaggctggtctccaactcctgacctcaggtgatgcacctgtctcggcctcccaaagtactggaattacaggcatgagccaccgcacctggcccataattgttttttctttaaagtaaatcagaaatatttcaactaaaaagaatccctgccccttccccactcaccctgccatcccaaaggtaacgcctgtgaagttggtgaatttctagacctcttttttgtgcattctcacattaattttgctcagacctacctagataaatatgtttaatcacagcttcaaaactttttgtgtgttttggagacggagtttcactcttgtcccccaggctggagtgcaatggggcgatcttggctcactgcaacctctgcctcctgggttcaagcaattctcctgcctcagcctcccaagtagctgggattacaggcatgtgccaccatgcccagctaatgttttgtatttttagtagagacgagggtttcaccgtgttggccaggctggtctcgaactcctgacctcaagcgagcttcccgcctcagcctcccaaagtgctaggattacaggcgtgagccaccacgtctggcccccagctttaaaattttaaggaaagccgctccccctttctgaagaatatggagcctgcctttttggtctttcactggagaaccaactccaaggtttcctgaaagtttctcccacgtggctgaaattcctcataaaagatttaacaagcgagtttaacaacctgaattctgtaacccaacctaccatatataaattcattgccgacttcaaaagcattgtgagataagttagctgctggcgtgatgtccgtgtcaagggaagaggtgggttcttataactctcagcattgagttgatggccccgtttcaacaaggcattttgactctaaaagcaaactgttttgagccgaccacctggtctcatcctgcagaggggcttggtgtttcagggtcctcaggaagggcacgatgttggttattcctggggtgtcgcttagcaggtggtggtctggatgggggcacagagcctgccacggtgaggcaggttctgctttaggtgatcagttactaaagccgtgtgtctggacccatttgtgctgctgagctctgttacaaatctcatgatcgcttctgaggtctgtgagcaacggcctccctcctgtctctctccccacagacctttcccctccagcctctggagcagggcagctgtttcgcaggccccgacgcggcatggtttaaagccccagtgccctcacgcatgaaaaggcagtcatatcagccacacatcagttctgcaaacccaacttcacatccttgtctgcctgccttctgttttttagctttaattttgaaaagctttaacacttacagaagaatttctctgtcccttttgtctgaagaccccatttagctttctccagtcagctccatgagtccattagaaaaaaggactgagaccctggtcctaccacacatacctccacttttatcgggaacaggtcttcaggcttcccttgactttcatgaccttgaggattacaggtcagctgttgggtagaagtgtctcagttggggcctgtccagtatgtcctggtggtgagacccaggtgtggcatcttggatgagaatgtcacagaagccatgcacagtactcacttgtccccttaccagcacggggtggccgtgctcctcgatcagggtgctgtctgccaggtttcaccactgtaaagctactttcccctttgtgctggatggtttctgagagacactttagactctgggactgtgtgtacctcatcacactcctgccctccagtgttcgcgcccagtgatgtctttagagtgatgtttcccgctgacgactgccccatgggattttcttcctttttttttttttttttttttgagactagagtcttgctctgttgcccaggctggagtgcagtggcacaatcttggctcactgcaccctctgcctcctgagctcaagagattctcaagcctcagcctctcaagtagctgggattacaggcactcaccacccgtgggatactctgagcaccatccctgccgcgttgattagtggtgttcactggaaggaggagcttgcccttctccccacgtgcttgttccttgatcgattgtgtcaacatagacaggcgagcttctgttggcatcagtgggtgaccgtctatggttactggtttttatttaatgttcaggttgtcccagatttggccagtggaagccctgtcaggcaggtccccgttgttcatttgagcactgcccttactttgtcacaacaagagcctcccggctcagcctcttttctcatcccagtcctggaatctgcatttctcagaggcacgctggttcttcagggaacatggtctttagaaaccaaggtctgaaatcactccgtgcggtactgcgatctcactgactcaggtgtagccctgctcccggccctccgcggacagagctggggacacacctttgtccacatgatctcttactctctgcctgcctgcctgcctgcatgtggagatgacggacagagctggggacacacctttgtccacatgatctcttactttctgcctgcctgcctgcatgtggagatgacgccaggggcacgtgggtgcctcccttggtatattcctccctcttctggcactaagaaaccggcaccctctgtcctctgtgcatcaggcatcactccctgcccaccgcatggctgagcctcctccccaccctgcaccagcgccgtccacgcacagaccccagctccagccaggctgccttctcagcatttgatgcacacagtctcattcccatcccttccctggttaaatcggggctccctggggggcaagcatggcttcccacagacatcacttggggctctctgaggcaggcgaaaagcaccctcagacagggagcctgccagcttcccaggagggcaaaggctgccggcgggaggggtcctcttcctctctggagtgatgcgcatccctcagagactggtgcagcatcctctacaggcccacaccctttgggtatgtggcaggcgtcgggctctggccatgattcagcagcttgtgttgcgacctgtgttgcagaagaaaatttctggaaggaatgagaagagaccacccttgttttcgtggagcagggcctgtgacagggacctccagattttggctacccctggagcacgccttgtctgtctgcagctctggagagggccacgctctgggcctagcactagtggcaggtcggtggcagggattatccaagtctcctgcttccgcttggcagctcgggccagcccccaggctcccctcagcgttagcgccagcgctgcacggagcggagtgtggaagggcagtagtcagtctgtgaccaaaacatcagcgtggagagccagcttgaagagcttgctaaaaactatctaaattgtgaatttgaccttttaaaaatgtatctaaattgccagtcgtcttctgcatagctccgtgctttggaaatgtaattgagtgtttccttcggaaaaggaacatctggcggctcacccccgcatcctgcaggatctggctctcctgagtttgtttttttatgaccagtctgttacgggagaggcaccagctctgctaacacaggctgccagaagcccctggggctggactccctcatacaactattatagtaagaagggttgctgcaatcctcttgctgcccaggcacagcggcgcctccggggcacagcgggagaggggtcttccttggcctgctgaatcttgatttggagtctgaaaatttgggctgacaaggtgttttgggttttgttgtcatcgttttagtgtacaattgagtggttttagtacatccacagagttgtgcgaccatcacgtgattaattttagaacatttccatcatcccaaaaagaaacctcatccctgttagtcacagcctgcccccaaccccctcccttgagccctggtaaccgctcagctcctttctgcttagtctggcatttcacagaaatgcaatcagacagcatgagggggtgtttttcttttgatttacacctttaatttcttccaacaatgtttttgttttgtttgagacaaggtctcactctgtcgcccaggctggagtgcagtggtacagtcgtaactcaactgtaacctcaagctcccaggctcaagtgatcttcccacctctgcctcctgagtagctgggactacaggcatgtaccaccatgcctggctaagtttttaattttttgtagagttagggtcttgcagtgttgcccaggctgatctcaaactcttgggctcatgcagtcctcctgcctcagcctcccaaagcactgggattacaggcatgagccactgcacccggccctaacattgttttatagttttatcttgtgaaatgtattcccaagtattttattccttttggtgttattgtaaatggaattattttcttaattttgcttttgggtcattcactgctagtgttagaaacacaatcgatttttgtatattgatcttgtgtcctgtagcttgacaagggggtgaagcttagcacaaacgcagggctacctccaggagccataatgccacagtctctgtgccttgcccaggaacaggcttgcctgcctgagtcacaggccttttatgacaatccttcctgttgtggatcagattagaccaccatccccactccccgtatgggcacagttgccaagacacacagatgaaggggtccatgtggacaggtggctgggcgaggctgggctctcgagccatcccaggagctcgtgggcattcacctttccctctagttttgtgaatttgtcagcccggactctggcccagggggagctggcctcctccacggtggccaggagtgccccctcactgagacgggaagctccgcaggcacatctggaaaggggaggcaggctcactgtgtgccacctttgaccttttcatcacaaaaacctgtctcacttcccagacatctgtagtggtgccaagattcttcctggccacagccgcatcctctgacagacaagccttctaggaaagggaagtggggcctgagcgcctgtgttccgtggctccctgacattctccagagccaggtacagggccgctgagcagctcggctcctgagcctgcagcaggtcatagacagctgggagggcggctgacgccccacctgcccccatggtcagcagctggcccaagagccatcgttcctcctgcccttgtctctcccctcctccaggcgccttccaggcctgctgatcggacgagacttctgttgtaatttggaaatgttctccctggttctccaggcccgaagtcactgaggccaagaccatagtcctctcctgcccttgccccccaggcccagccccagcccaggcaggcctgctgttgatattttgtcttgtgcttttagaggaaaggagcagtggcttccggttgaagccaccaacgctgatccacggccaagcccccagcgcaggtaggtcgtctacctccctggggcggggggtggctctctgacgtttttcagacctctgctaggccacaccagggcaccgcgggctcagcctgctttctagaaagatcacttgtaacttgacccacgagccctggaaagttcctttaaagagaggctgtctgagcagggaggttgggacccctgactgtgagcgtcgtgtgttcagaaaagtgggcagtggtggcacgggagcaggctaggcggggtgcatcgggcgggctccatgcccagcagtagcgcacttggttcagcctgtctgtccttcatgttctggcccccacataccacagtgttcgccccagttagcagggtggctgcattccagcggcgcgctgctagtgagccggctgctagtgaggctgccggggatgctgcacagggcagggcacatgcaagggtccttgtcccatctgcctttggcagagggacttcctcagcatggctgttttgaaaaacaggtgcaaaatgtgcctgtacgtgaccccacaccgagtcctgagcctccaggtagctgcctgtgaatgcactgctctcctctcacagtctccacttgactgttgagtctgccggcgccccgccacgttactgtgctaactggattaattcacaggcgtcggtcactgggagtttcatgtaatcacatgtaaaaataacagtagccagatctcctggccagctgttaaaaaaagacctcaagtttttaaaaaagtgcttccctgcaaagtctagcctgcaaggggcatgaaatgggatgccaggggtcagtctctgaagcgcctgggggcaggcaggggtccacgggcactgggaaggccgccttctgttcctaggtctgccaagccagaagcccaaggagcagcagcggagcgtgcttcgcccggcagtgttacaagctccgcagccaaaggcgctgtcccagactggtaagaaacagcagccctggcgcccaggcccagacggcagggtagagcgttcccgaagtcgcacccgggacagcagtgttgcgacagaggtgactgctgaatgcaccagaaatacagagagatcagggaagatgatcctttaaatcaccccccagccgtctccagccccaagcctcctgagccctggcaacggagaagggagaggcggctccacagcttcctcacagctctcggctgagtgtgactgtgtgggtgaaacctgctttgttcattcactgtcttcataaaagcaggccggctcctgggaatgagatttatccctgtgtgtttgcagatagaatttcagcctcaattttcacaggttatctttaaaaacttgaaaggtcattttatttatttatttatttatttattttggagatggggtcttgctctgtcacccagactggagtgcactggtgcaatcatagctcactgcagcctcgaactcctgggctcaagcgatcctcccacctcagcctcccaagtagctgggaccacaagtgtgcaccaccacacccagccagtttgttttatcttattttagaaacgaggacttgctgtgttgcccaggctggtctcaaactcctggccccaagcattctccccgcttcagcctcccaaagcactgggaccacagacatgagccactgtgcccggcaggtttctcttttttgtttgtttctcttgtttttttttaaatccaagaattttggctctttgtagagataccaggtccttccttaaaaaggagacatgtgctgtgggctttaccatgggaggggccctagactagacgtggcccagcccctcagctatgtgagtgggggtgggagggccgccaagcacctgtgattccccactctccttccctcccacagtccccagcagtggcaccaacggggtcagcctcccagcagactgcacgggggcagtgcccgcagcatcccctgacactgctgcatggagaagtccttccgaagctgccgatgaggtgtgtgcacttgaggtcagtgggtcctgaggcagggaagcgctgcatgctaggccccttgggagcgggagggcagccttcccagcatgctgtggagtccacacgctgtcacctgttccaagcagtttccacgtgggcctattgtaaggctctctggatttgctcagtaggctctaaataacagtacctgacaaaccagatctagattcccaagggtggtcttgctggtcaggcagaagaagagtgtctcccaagcaagctctgccggaaggacctgttgcccagagttctgccggaagggcctgttacccaaggctgaccgccacatgtctcacgggagtgatccttgagggaggacctgaaccactgcactctgaggagtcactagggcccgaggaacggctgtcactgatgggtgtcttgcaatgtttaacatgaggaatgtctcccctctctgtgtccacacccaaaccacccctcagagactcctatctgtgtggttccagttgaaaatttttctttgggagtcatctcagaaatagtttgtttaggccggacacggtagctcacacctgcaatctcagcactttgggaggccgcggcaggtggattgcttgaggccaggagttcaaaaccaccctgggcaacatagcaagactctgtctctacaaaaaatacacagattagccaggcatggtagcatgtacctgtagtcccagctactcaggatgctgaggctggaggattgcttgagcccgggaaggggaggctgctgtgagccgaggtcacaccactgcattccagcctggacgacagagccagaccctgccttaaaaaaagaaatagttccatttaagcgggggtatggtttggattatatgggccaaaagctttgtgtttcacagccactgtgaaataagggcctttgatgaagagcctcctttgaagttggcagagatgggtttgaagtcagaattagggtaacaccatgtggtatcttctgtgtaaaagccagattggatctttgtgtttattttccgctctgtgtccatggcctgcagttttataccctccatccccagtagatgttctggctcaaagggtgaaaatggctgtccacaattaaatttgaaaacatcctcacgccctttttcaaacgagtttgctgaattggaaatagggatcatttccaccgcattctgcggcttggaagctttgactgctgaggtctcctgagcagatcaggtgtgcagttctgagttggagaaggacttagaagtgacccagcccgtcccgccatctcccagtgtctctgattgtccccgatggtgagtgcacaggctgacctggtagcacccgctaccgagagcttgttcctcactggagaggccttgctgtgtcccatcccaggggacggagtccgtcttcctgccggttccagccccttctcagcagtgcacacagcttgttcccaaatggttgagctcagaagttgtgatgtgctggctgccattcccagctcctgcgtctggctccaaagccactgctccatgtgggtctggggtggagccatgcggccacacccacgctgccctctgaccacacccagtactgttgagattcgccaggctcgctgtgtgtatccttctctggccctacagcaggagtccgagcttttccaagccgcccatgaacatggcacacactgctcatcgggaacgtgagctatgaggcatctcctctaaggagggcttagatgttgggggcgacccatgggggaactcctggtaccgtctttgggaaagtggggaagaggcttcccctcccgccccacacacacacagagtctcagactggttacaggcctcgggattcgtttatcagtttaagcgaatcctctaagcaggctccgccaggtcatagacataccctgtagtcagaaacattttgctgtttgcctgccccatctcaggtgactctgtgggctccacccacccgggattagcaccagtcggtgtgagcagggggcacacagcgcagaaagccaagagccagggagtgtttctgctggacgggatgcaggcggccccagtggggctggggattagcccatcctctgaggacttccaggtcgccaaacacgttgtgtgtttaattttaaaaagccacgttcactcttgcacaggcacaaggatgcagcgtgaagtcagcagtagcagaatttctagggagcacagtagagaaacatttacacttttcacttccttcacagttggaccagaaagtgccctcagcgctgtgatccgctgattctgggcctggcattgtaactccaggcttccctgcccgctggacacgctgagccagtcagaagctgcctgcagcctttctcacctccgagttcacggttgtcaggtcccttcacgacatctcccaggaaaacactccctgcctcacgttcatgtccactgtacacatcgccagagactccaaagatctgccaaaagccttttaaaatttcttttcaaattctacgacacctttttcatcatgtggtataggaaagacatatacaaattactagcaactccatattccattatctcaagataaatgcatttggtcttaggatatttagttacaaaagtcatgcctacatgttgaaaatatttacacaaaatggaaatcctagaaagtaacaagcaggagccaccctccagctaagaggttcccgggtaacctccgtcagtagtttgaattctctctcccgacttattttcctgggcattcctcaacacacatacacaccacacatacacacacacacacaccacacacacgggactggattggctttaacagaaatggaatcgcacttccgtgtcccacaagctgctctcttctctgatccatgtattgtgggcatgtcagaggcctacctccctctcggtggtaatagctgtgctgtactttttttcccccatattttctattgtaaattatttcattccttggccaatgatgagcaaccaggttatttcctgtcctctgccggcactaaggcttctgcagggcacaggtgtttcttgttgtttggagacaggtttttgctctgtcacccaggctggagtgcagtggtgtgatctcagctcactacaactcccaggctcaagcagtcctcctgtctcagccttctgagtagctgggagtgcaggcacatgcagaggagacgtgtggagtacgtgatctggtgtgggattgctgggcatccgtctgggccaagtgtggcactggttttgattactctgttttgttttggtttttgataggagaaagagccccagaaaaatgagtccagcaatgcctctgaagaggaagcctgtgagaaaaaagaccccgccacacagcaagcctttgtatttgggcagaacttgagggacagagttaaggtatgtgagctgttgaaccagcacattgactttttatgccttccccaggttcaacagcaggcaagtaggtagattttccttttaacaggggaggggagcgtgggacaaagaaggtgttagcgaggcagccccatggctcacggcacagtctgctgctggtgtgcgtgtgctgggccctggcacttccccaccagcagcccaggcttcggagccctcacctgcagtgacttctcaagtcagggtccctggttctcatggtagcggggacagggaaggtgactgaacctgaggcctcaggctttcatagcagagaagaaagacagcacggtccagtgttctcagctctgcccagaggtttctgttcccgtatttcagggtttctctgtttcagcactagcagcattacggctggaccattcttagtttctgaggagtcgccctgggcactgcagggtgctgagcagcatcactggcctccacccacccaatgctcctgacatctgacaaccacaaatgtccccagacgtggccagtattccctgtggagtagaatcgcccccattaagaactgtcaccttatttttttttaagtggggcagggtggggtgacaacactgtcttctctcctgaaagggagcaaagcgtctgccacctcttggctgccctccagacatgtggtcctagtttggagattgtgtggtggggaagggatggcagtggttggaaacagtggccctggaccatgcactgggactctaggaagaccagggtcagccagcaccacctttcccagccacagacatggaatgtgctacggcatctctagcagctccactggcaagaagcttctttcaaagctcgagaggcggtatcggtggctgtatctagagacttttgtggttgtcacaactgggaggtacttctggaggtcagggatgccactccgccccttgcagtgcccaggatagccacaccacagggaatgttctgggcccagtgtcaacatgtcagtagtgtcgacggggagggccctgaaataaacaaaaacctctctagcatgcagaaagcaccggcttgtgttttctgctttcctttctgttactcaccgtccaacagaagcccaagtcgagaaacgtggaaagttgatgttgctgttgccatggctttaggcaaaataatgagtccctcaggggctgttccctccaaggagggagggcaagaggcggggaagggcttggcctgtggagttcaggccctgtggaatctctgccttgagtctggggagacagctgctttgaatttggtggggttggcttcttgcagaagtcagaggcttacgtgcacttcgcagtctcagtcaaatcccagcctctccttccagggcaaacttgagccatggattctttttttttctttggacacgaagtcttgctgtgtcgcccaggctggagtgcagtggcatgatctctgctcactgcaacctccacctcctgggttcaagcgattctcctgcctcagcctcccaaatatctgggattacaggcgcccactgccacatccagctaattttttgtatttttagtagaggtggggatttctccatgttggccaggctggtctcgaattcctgacctcaagtgattccccgccgcctcagcctcccaaagtgctggtattacaggcacgagccaccgcgcccagccagagccatggtttcttaaccctctgagcctctgcttccttgttggtcaaacagggtccctaacatccccctcccaggcctcgtgaggattaaagcagatcgtgcatttgacagactcagcatagcagctggtaggaaagaggccctcaagaaattctgcttctatcatgttcatagtaaaccccccaaaacgtcagctttgtaacgttgtgttattggtatgaagcattgaccgagaggccagcttaggcgtggttttataacaaggcgtggttttgtaacaaggtggaaaaggctccttggagcttcatgagctctctttccatcctaactgttaaagcaaaaggtgatggagttgattatagccctgccccccagcacatgcacgcgcacacacacaggcgggtacaggagagggttcatggctccgagcagctccatgcagctcagggggtctgcagacactgagctgtggaactccaggcacccccccacccccgattactgagcgctccgtctcattcccagctgataaatgagagcgtggacgaagccgacatggagaatgctggacaccccagcgcagacacgccaaccgcaacgaactatttcctccagtatatcagttccaggtgtgtgtctcggtgtcagcggccagcctggcatggcgatgcaggtggccgcgagggcttctgccagagaggggtctgtggtccccgtgcccgactcaggcccagaatccaggttgctctcaggcccctctctctcattccccactctgggcacaaccttgggtgggccagggtggtgggccttgtcctgggattcactggacgcctgagacaggaccagagttctgtggggttgtccaggggcccatggaggctacagcccagcccttggagtgtgccctctgtcttgtggacctcatgcccagagcagaacagagcaggccagaggcgactcaggcgcccccttattctgggtttgggcacctggggcaaagacctcatcatgtccttgactgacatggctgggggtaatgctacccacggaccagctgcccctccaggtgtctcagaagaaagcgtgtcccgactgggagatgggcgggtagagcaggtggaaggtggcttccctcatgctgtggggcccctccatcagggcgagctaagggttaatgttttcaatggcacagggaggtgtgtggcttcctgcctctgacacgccaccccgtgcacagtggcggaggcccctccactgtgccctctgtgtcagtgtgtgctccatgggtacccatacatttgcctggccacgttcccacgtgacgccccacactcattgcacatcttctcttcagtttagagaactcaaccaatagtgccgacgcctccagcaacaaatttgtatttggccagaacatgagcgagcgagttttggtgagtggctgtgttgggaatgttctcagggaccagaggctctcggcgccagccacaggtcaaggggacatggagagcagggctgctgtgtcgtcctatgtgagatggggatgccttcagtagcaagtgagagagggaagaccctgctcagactcagcctgaaaactggccagggccactggctgcctacgaactggcattcgcttttcccggctcctccgtgctgaccagggccaacttcatcccaagatgggcttccctggaggctgcagggtcctgctggcagtcggggtccatggttcctccccaccaggccaactgacaaaagtcctgtgggacggagccagccgtgctggtggacagggttgctggcctccctgctcctgtgagcataaccgcggccaaggccttgggtgcacgaaaggcccatctccgttcccaggagcccagccagcctgggagagggttctagaatggtttgcctacctctttacacatgttcctttttcttcctgattccacccagctccattgcgactgcgtgagggcctgtcctgagccgcctggtcactctagctctgtctggagttaggctgcattaagtactctgcagcttctcttccttcgtggccacgctgtgctttttctatttcaatgaaatgttcaaagtcttgcctcacccagacggagtgaccagtgtggctcgaggggactgtcggctggtggcactcaccccgtagtgatgcctgagggaccacgtggggagctcccaggcagttcagggtgtcaccgggagtgggcaggagtgctgggggcagcgtagtgttgggggccaggcagagaggtgctcagagctgctgctgaaggaccacacaagtgccctcttccttgtatgcttttgtgtccctgcagagccccccaaaattaaacgaggtcagttcagatgccaacagggaaaatgcagctgccgagtcagggtctgagtcctcgtcccaggaggccacccctgagaaaggtatgttagcgtcccaccacagcatggggctcatggtaggtcatcttgggggatgctgggtccattcacacccccagccgggagggataaggggcccgactcccgcagcagtaacaaccacatgtgaaccagctccagggccctgccttgcagtgagcaagggtttgtgataaagaactcgagggcctgtgtcgccttgtggccgtggggagggtggggaggcgcaggcagcaggcgtggaggagtccctcactgtccccccgtcgactgctcggcacgaacacgagagtctggggccacacttggcccccagatggtctccctgcagcttctgaggccatatgctctggctgtgtctagggtccacttgggttgccggggcaggcctgccaggggcagcaggcgtccttgagaccagaaccaaccctctcatctcctgtcggatgaggggagatggctctcctctcgccaaataatcagtcagtctttttggccaataacttttcagagtccctggctgagtcggcagccgcctacaccaaggcaacagcgcggaagtgtttgttggaaaaagtggaagtcatcaccggggaggaggcggagagcaatgtgttacaggtgaggggccggcccctcctcggtggccctgggtcttccatgcacctgggggtccaaccgcaagggctgggcccacatcctctgagcacacaggcctgcccctgagatgacggaggggccactggccccacgctctgggactttgttggtggcgtttgtagagagagcttaggctcaggggcttcttgcatgtctttggtttcagaggaggaggatctgtttgagacattctttgttttgttttaattttttttgagacaatgtcttactctgtcacccaggctggagtacagtggcacagtctcggctcactgcaacctctgcttcctgggttcaagggattcttgtgcctcagtcgcctgagtagctgggattacaggtgtgcaccaccacgccaggctaatttttgtatttttagtagagacggggtttccccatgttggccaggctggtctcaaactcctgacctcatgtgatccacccgcctcggcctcccaaagtgctgggatgacaggcgtgagccaccacgcccagcccgagacatttttgatggttcagggaatgacaaagactgtcataccaaacatattctcttgtcgcccagagctggcaactgtattatttgtcacctggcatcctgtggtgtcttcgtagggaaaagatcaggtgcggccagaggttccaccccaccgtcccctcctggcatcccccattcctgctcctcaggccgcaccacccggcttgggcagcatccatgtgcttcctctcccgtggcacataagcaggtgtctgtgtctgtaaaccgggtggcgtatcgtggcgttcttaagagcactgttcttttttcccacttaccactttgtcatctgttcatgttgaaagagattgacttagggggtatgtggaaagccatgtaggggtgtctgtctcgtatttttctttgtttatatatacaaaactgctgtattgaaatatagtacaaatgctatataatccatccttttaaagcatacaattccgtggtttctagtatattcacagagtcagacaactttcaccagaatctaacgtacaacatttctgcccccaaaaagaacactgtcccattcccccagaaagagcattgtccattcgcagtaactcctcctccctccccagcccctggcagccacagatccacttcctgtctctgttttttgcctgtccttgacatttcatataaatggcatcaacgcactatgtggcctttcgtgtctggcttctctcgctgagccagaggttcatccacgttgcagcgggggtcggagccttgttctttattaagactgagtgagatgcgctgtaggggcggaccatgtgtgtcactccattcctccttgagacttggctaccgtgaatgatggtgctgtgcacgttcatgtgcgatctgtgtgtgaacacgaacaaatgttccatttctcttgggtacataccgaggaatggaattgcttgggcatgtggtaattccttgttaagcagtttgaggagccgccagactcttccacagcagtggcaccatgcggccttcccgccagcagtgtgtgagggttccagcttccccacatgggtatagccgtcctagagtgcgcagagaggcttctcaccgttgttttgcttttcatttccttagtgattcttttaatttcagataccccttatacaatgtaaagcctgttctagcttgagggcaggacaaaaaactgaccaaggtggcccccaggccgtcgttggctggccctggcagtccccacaggctaaagggcgactctcagggtgtggctgcagcaggacaccagctggggtccctgcttaccggcggccactgtgttccagatgcagtgcaagctgtttgtctttgacaagacctcacagtcctgggtggagagaggccgggggctgctcagactcaatgacatggcgtccaccgatgacggcacactacagtcccgactaggtgagctgccgacggcgggggctgtggccgggtccccatggggagggctggggactatgcaattccaaagggaatgaagcgggggagatcctgaccctacccttgtgagagtcaaggcacagagtcggtctcccatgagagccgccccccaaaccccctccctgcacccagccctcaacaccaccctcacacactggctccagctgccagctcgtccgtgaccctcttagtgtcaaaatggacaaaagtctatggaagtttttaagctgattttctgacaaagtggcaggtttatgatagaaaggaaaatgaaatcaaacatcaagtctaatctcttgataaagacaaattttggccaggcgcagtggctcacgcctgtaaccccagcactttgggaggccaaggtgggcggatcacctgaggtcaggagttcaagaccagcctggccaacatggcaaaaccctgtctctactaaaaatacaaaaattagccgggcatggtgatacatgtctgtaatcccagctactcgggaggctgaggcaggagaattgcgtgaacttgggagacggagattgcagtgagccgagattgagccactgcactccagcctgggcgacagaccaagactccatctcaaaaaaaaataaaatatactgtttttgaaaagctttcatgttaatattccattgacagtcaatggacttttccctattggtggacatttagcttggagtacctgcatacacacacccacttaaggaaatcagcctgtgtgtgtgcacatttgaaatgtgggcgtgtcttttttttccttctaaagctgatttcactccatcacccaggctggaatacagtgtgatcatcgcctcaaattcctgggctcaagtgatcctcccacctcagcctcctgagtagctgggactacagatgcaccaccacgtctggctaatgtttttatttttgtctttataaagacaggtctccctgtgttgcccaggctggtcttgagctcctggcatcaaacagtcctcccacctcagcctcccaaagcgctggaattacaggcgtgggccactgcgctgggaccatctttttgttttatcttcccaaatcaaagtgtcttctggccttttcataaatatgggtttcaggcccagcagtaactcaagcagcccccttgaagggtagtgttcatgcacttcaatcagaaacactgctctggtcagaacagacaggggatgtccctgcaggctgggactgctcttttgttccccatggacgtctttttttttttttttttgagacggagttttgcccttgttgcccagtctggagtgcagtggcttcgtttcggcccaccgcagcctccacctcccaggttcacgcgattctcctgcctcggcctcccgagcagctgggcttataggcacccgccaccaagcctggctaatttttttatactttaagtagagacagggtttctccacattggtcaggcttgtctcgaactcctgacctcaggtgatctgcccacctaggcctcccaaagtcctggaattacaggcttgagccactgtgcccagccttatggacgtcttcttgtgtttttccttttgtctcgtggaaatgttcaaatgtccatggaaagagagggcatagagccctgagcccccaggtcatcccctctgcctgggtcatcagcctgtagccccgtggcagcagtaccctccccagcttcagggagagcaaaatcacctctgtctttctcccactcggcctctgaggtgggcacctgggctcagggaggtctgttcgctgggccagggcagggggacaagtttctgaccgtctccaggcctgctccagtggggagaggcggctggcaggaaggtaggggcttggctgagtccacggggtgggcccaggccaggcgcaggggtgttgcatcctctagaagagtcagggccctcccattttcctccgtaatctgctgcccacagtcctctcgtctcctctccatggaagcgctaagctgcggtcctactctgccttctcctaaggaaaccagagggcagggctggcccactcaggggaggccagtcaggaggacgtggactcccatggaggccgatgtctcacacacacagaaagcgcatgcaccttgagtgtcagcccctgcctcccgcagcccaccccgtactcctctctaatccccccttctccaagggaactgccatcctggtgcccacctgtgtggaccaaacacaacctcccacaagctgcatgtggcctctggtcactgatctgcagcaccagcctgtgcagccacctgcagttgtggccttcagtggtccaggcttggggaggaggagccccgccccgggagcaggtgtgccagggctggcctcagggagaagtcttgctctgtgggtgggtcctgggaggatcatgggcttttgcgcggtgatgtcgctttccatctggactgtgttggctcttggagctggctgtttgtgagggggccggtgtgggggccagggctgagtggccttgttggttgtagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggtgagccagccacgcgggtgcatctgggacccctcatcctgccagccctgtgggggttcctgggcacacagatcaggcaggacggtggggaggggaggggggaggggcttcagttgcttcctgggacacaagaagcactatgggacccgccagtcccagccttcaggaatagagatcatggtccttgtcctcttctcaacccagagaagccgctggggtttggctgaggggttgtgatgtgttcagggctaacagccctgtggggcggtcacctctctcctatgtcatggtgtcacagttgagtccaccaaccctgacctctgggatattcccagccacctgggagtggtggcatcctttcggggagaggccggcaggcccagggccaatggcctccccacaaggccttgtggcagtgtcacctctgaaccttgggacttggcacttgtgttctgcagaaggcaggagggggtaggactggggtccgggggtctcataccctcctcccttcccaggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgagtcgggtggtccctaccctgggggggatagaaagagctgcccgccatccttgatccagtgctgatctcctggcgggggtggccagacctgggaagtgcgggctccatcctgatgcggggctgctgcttccctgcaggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaccctggcctctgcatgccccaggggcctcaggaagcccctgaccaggaacggcctccacctccccgggcgaggacctccagcagcctggggcctcatgctcccacccagcgtgtcaccagtgctggggtccagccacagccctgttctctccaccaccacccgcactttacccccacccctgctgcaaggccccgccggtctgcccccgcccagagctcccagcctcgggccgctcaccagaatgtagacactgggcccgctggacgtgttacctgctatttttattccccatttgccatcttctgattgggggttgatgttttacagatttttttttcaaaggctttatttcagtttctgaggttaggatgcccctgtgcccctcgctccacacctgggcaggtctaaacttccttccaggatggcctccacacacagcctcccacctggggtcacctggcttcctgggggacccgcaagggaggggcagggagcagcagtccgggtgcggggatcgggggacctcggcgggggcatccacaggggctgcaagacctctggtcagcatggcgtgggtggggagagcgtttctccctggggtcctgagccagtgactcctgttaggacctttgtcccacctccgcctggtggaccggcagggacctggtctagccagtcctgcagcctccattcccccacctgcccctccccgctctgtggtgtggctgcccaggagagaaggggcccagggaagggaggtctccggcaggggtggggagtgacaggccagggcagcagggctgagccggagctgctcacagctgccaggcactggtcatcatggccacgaactcctcatccgtgttcatggaggcactcacgccgctgtagtagtcctggaattccgccagtgtgacctgggaacagagggccgtgagggggcacggccgaggaactgcctggggagggggccccccgcgcagccacccacctgcccgtccttctcagaggagtcgaagttgtccaggaagcggcgcagcacctcgtcctcggtccactccccactgcgcaccttggggtgggcacggccactgtacaccccgcggaggtcgtccaccgtcacgacgccgtccccactgcggtccagcttggcaaatgcagctgcgatgacagcctcccgggcctgggacatggggggctgggacaggaggtggtgactgggggtggtgggtagcacacccaaacccccaagacgctgtgcagagcactggggctgtatgccccagcaggcgcctcttaacagcagctcttagggaggagtccccgtctccgcatctcagcatcctctgtcgccccatgcccagggcacacgccttgactgtgaggtgggggctcacccgcagcgcccgaaggaactcctccagatccagcgtcccgctgccattgcggtcccacttcctgcacacaccctctgcctccgcctggtccagcaccagcccgagtttggccagaccctgccggaactcatcagcgtccagggatctgctcccgtcccggtctagttggcggaaaaacctggaggcaggggacacggttggaacagtggtctcaggggccggggtcaggaaggtgagaggggacagctcacctggccaggccctggatgcccgaggccccgcgggacaggcactgtgcccggagtttctccatggtggcatccacggcgtccatgcttggtctgggctctgggcagctggaagggagagaggtcaaggtggggactcccgcaagcccaccctggccgactgccccttgttcagatgctcacctggcctgcgtctgtcccagagtcctgcctgcggggccttgtgttagctgtgttgtgcctggggagactgttgctagtggaaggtgcctctggagatggggtggggcccagctgcatgaatgcactgtgctgggcagtggggagtgggggagggatgggtgcgcccagcctg

SEQ ID NO: 14331 - DNA, 45833 bp, Human; identical to SEQ ID NO: 14330

SEQ ID NO: 14332 - DNA, 45833 bp, Human; identical to SEQ ID NO: 14330

SEQ ID NO: 14333 - DNA, 45833 bp, Human; identical to SEQ ID NO: 14330

SEQ ID NO: 14334 - DNA, 5397 bp, Human
taaatattaagatctatataataaaataatcaatttatttggagttttataagttgtccatccagatgcatctctctaaactgatgtattaggaggaaaaatactgtcaatgaataaacatcactatctttctcattttgtagcaaattttaaagtgaaagtaatagaacattactttgggggaacaatgcaatatttatgatagtgaacattattgaaataagttcaaatttttctttatggattttaaaaaacatgctttcatatacaaaaacatgtaaacatctgcctaaaataaagttgaaatagatatttttgaaatggtaattatatgacctatttcttattccagttttctgttacatatgctatatgtaatagaaaatgtaaataatatagtattaatataagtatagacatgcgtataatatatgatcaatataagtacttctcaaatgaaatctctgtttccaaactatgtcctaagttgtgtgcagagcttaatatgtttagcaaggcatacgaacatacagaaagagaaaatatgctatagaacttacaaaactgacattcactaataaaataagactttcaagtgcttatttttatttgttatttttaactttattatgggtatataatagttgtatatttttatgaggtatgtgtaatgttttgatacagacatataatgtataatgatcaagtcagggtaattagagaacacatcatctcaagcctttatcatttttttgttttaggaacattccaattccactcttttagttatttaaaaataaacaacaaaatactgttaactagagtcaccctattgtgccaccaaatactagatcttatgcattctatctaactctatgtttgtacacattaactatcttcactttatccttctgtctcctctatgctttccagcctttggcaatcatcatttcactctcaacctccattgagttcaaatttttttttagctgccatatatgattgaaaacatgtaacatttgtctttctgtgtctgacttaattcacttaacataatatccttcagctccatacatgttgttgcaaatgacagaatttcattttctttatggctgaatgataacccattctgaatatgcagcacattttctttatccattcatccattggacacttagattgctttcatttcttggctattgtgaatagtgctgcaaaataaacacgggagtgcagatatctctttgatatactgattttctttcatttggatttaaacccaacagtggaattgctggatcatatggtgggtctaattttagttttttgaggaacctctatactgttctccatagtggttgtactaatttacattttcatcaaaagcgtaggagcgttcccttttatccctacccttgccagaatttgtgattgcctctcttttggataaaagccattttaactggggcgagatgatttctcattgtagttttgattggcatctctcgaaaaactgggtatagaatgaacatatatcaacacaataaaagtcacatttgttaagcccacagctagtatcataccaaacaaggaaagtctgtaactctttcctctaagatcaagaacaataaaagcatgtgcacttttaccacttttattcaacatagttctctacttagataagagaaggaaataaagggcattcaaattgaaaaagaagaagtcaaattattcttgtttgtagacaacgtaatcttatatttaaaaaaaccttaaagtcctcaccaaaaaactattggaactgataaacaaattggaattagtaaagttgcaggatacaaatccaacatacatagaaaaacattagtagcatttctatatgccaacagcaaataagttgcaaaagaaaccaaaaaagaaacaccatttacaatagctaaaaataaaacaaagtatccaggagtaaataaccaaaaacttgaaagatttctacaatgggccaccatcgtcggcaaagcctgagtcctgtcctatctctctcctccccggacagcatgagcttcaccactcggtccaccttctccaccaactaccagtcactgggctctgtccaggcgcccagctacggcgcccggccggtcagcagcgcggccagcgtctatgcaggcgccgggggctctggttcccggatctccgtgtcccgctccaccagcttccggggtggcatggggcctgggggcctggccgcggggatggctgggggtctggcaggaatgggaggcatccagaacaagaagaccatgcaaagcctgaacgaccgcctggcctcttacctggacagagtgaggagcctggagactgagaaccgtaggctggagagcaaaatccgggagcacttggagaataagggaccccaggtcaaagactggagccattactgcaagaccatcgaggacctgagggctcagatcttcgcaaatactgtggacaatgcctgcatcgttctgcatattgacaatgcccgtcttgctgctgatgactttagagtcaagtatgagacacagctggcgatgcgccagtctgtggagaacgacatccatgggctccgcaaggtcattgatgacaccaatgtcacttgactgcagctggagacagagattgaggctctcagggaggagctgctcttcatgaagaaccacgaagaggaagtaaaaggcctacaagcccagattgccagctttaggttgaccgtggaggtagatgcccccaaatctcaggacctcgccaagatcatggcagacatccgggcccaatatgacgagctggctgggaagaaccgagaggagctagacaaatactggcctcagcagtttgaggagaacaccacagtggtcaccacagtccgccgaggttggagctgctgagatgacgctcacagagctgagacgtacagtccagtccttggagatcgacctggactccatgagaaatctgaaggccagcttggagaacaacccgagggaggtggaggcccgctactccctacagatggtgcagctcatcgggatcctgctgcacctggagtcagagctggcacagacccgggcagagagacagtgccaggcccaggagtaatgaggccctgctgaacatcaaggtcaagctggaggctgagatcgccacctaccgccgcctgctggaagatggcgaggacttcactcttggtgatgccttggacagcaggaactccatgcaaaccatccaaaagaccaccacccgccggaaagtggatggcaaagtggtgtctgagaccaacaacaccaaagttctgaggcattaagccagcagaagcagggtaccctttggggagcaggaggccaataaaaagtacagagttaaaaaaaaaaagatttaaacaatgaaaactataaaacattgatgaaagaaattgaggcagatacaaaaaaattgaaagacatttcatattcatagattggaaaaatctatattgttacaaagtccatactacccaaagccatctacaattcctatcaaaacaccgatgacattcttcagagaaatggaaaaaataatcctaaaatttatatggaaccacaaaagacccagaataaccaaagctatgctaagcaaaaataactacactgggggaatcatagtacctgacttcaaattatactacagagccatagtaaccaaaacagcatggtactggcataaaaatagacacatataccaggggaacagaatagagaacccacaaacaaattcacatacctacagtgaactcatttttgacaaaggcgccaggaatataaactgaggaaaagagagtctcttcattaaatggttctgggaaaactggatatccatatgcagaagaattaaacttgacccgtatctcttgctatatacaaaaatcaaatccaagtggattaaacacttaaatctaagaccttaaactatgaaactactacaagaaaacattggagaaactatccaggacattggtcttggcaaagacttattgaccaatgccccagaggcacaagcaatcaaaccaaaaaatggacaaatgggatcacagcaagttaaaaagtttctgcacagcaaaggaaacaatcaacaaagtgatgagacaacccacagaagggggggaaatatttgtaaactactcatctggcaaggaattaataaccagaatatatgaggagctcaaacaactcaataggaaaaaaagtgattaataaatagacaagagattgtaatagacatttctcaaaataatatatacaaatggcctaccttcaagtgtttaagtaaaagttgtttcctgatatcatgtccatttacttatgcaatatagagactttatttacctactgttttctttatagtacagcagatttttaaattagtttgtaatggagcaaacaggttggtgaaaatgtaaagaaaaagttttgaaattttttattctaaaaaacttcaattatattctctctctagatatgattgagttttatccctgttttatttctatgtgcacaactcaaaaaggtttgttgacaaaccagtcaaagcttcgaaattgggtaaattgcttagaagaaacttattttcaatttcacaaggaagaaattttaaaacttaagtcttttagcaatgtacagattgtacattattaccttggaggcatgtattttgtctgcattaaaatcatgcaaaggaacacgctttacaaatcaatttcactgtggacctaaagaccagatacaccaccaagtcccatttaaaaatggccttaatttagaattcaccctctcaagaacagattgagtattaaaaggtatgaaatgtttgagagctaaaattgtttcaaacattttggatagcttaaaggcatattttagaaatactgatttcttagtattttctttgccaaactgaagaaaataatggatccagccctcaaaattttgctttgggaatttctcatcgtcattaaaatttgtatattatcataactgcttcatgtacctcccaaagcagtgtaaccagtgccttagtaggaactttcaatggaccatgaaacaatttttattcccacatttatttttgagaaaagttgagtcctccataattcatatttcttgagttctttctgggagtcagcaaaatctttaaaaagattctttaaaaaaagaatttgttatcttaaatatccaaactaactgagaaggattttaaattgacatttgtgttgttaggatagtttgacaatgtaattagtgaagtcagatggcctgcagaaaaccaaatgaaaatataatgtgatcatatataaatttttctgtaagatgtccagttctgtatatc

SEQ ID NO: 14335 - DNA, 20922 bp, Human
agtatgtgaatttgatctcaataaaacttatttttaaaaaagcatatggtagttcacagagagattgcttccagctataacctaaggaaaggcttcaaggaaaagatgggttcaaagctgaagaatctgactctatggaaacagagtaagaacatttttttagagatgggatctcactatgttgcccaggctggactcaagtaactgggattacaggtgcacagcagtgtgccaggctaagagtaagagcatttttggcagggagaaacaggagtaaaccagggaggcaggaaattataggatgcatacaggggacagtaagtcattcagttcacctggtgtgtggggcccatggtggggatggtgttatattaaagaaggccttgagccaggcattcaggaggcttgaagtaggaggatcacttgagctcaggaggtcaaggctgcagtgagctatgatcatgcctcttcactccagcctgggcaaaagagtgagaccctgtcttataaaaaataagaattaatgaatttagaaggtcttgaattccaagtggaagcacccagaatttgagccataaacaaccaaaggatagcctgatctgagctgagcttaatttatatgctgaaagtatgagagactagtagggaagagaccagaaataaggagactgctagaagattgtgcaacatcccagttcatcctccacaaatgtggaggaagcagatactagcagtggttactaactgtaaattctgggattgtagagactgtgacccatgcagacagcaaaggcagggagatgcagcatgcagcgcagcatggcaccgatactggcagacactttagtagacttagggactttaactgcagagaaaatgtgaggttgcactaagaactgtgaatcagccctatggggctgaaaattgacagcactgggataagtggaactggaaagagagcagaagtagaaaaataaagttcagccgggcgcagtggcttatgcctgtaatcccagcactttgggaggtcaaggcgggcagatcacctgggagcaggagttggagactagcctggccaacatggtgagaccccgtctctactaaaaataccaaaaaaaaattagctgggcatggtggcgcacgcctgtagtcccagctactcaggaggctgagacaggagaatcgcttgaacccgggaggcggaggttgcagtgagccaagattgcaccattgcactccagcctgggcaacaggagtgaaacaccatctcaaaaaaaaaaaaaaaaagaaaaaagaaagaaaaagaaagttcaatttattgggaaaaaaagagccctttggaaacaaggaggaagaagaagtgtcggcaaagaagcattaggaggttcagggtcaaagaagacaaggaaagctttggcaagaagggcagatggggtgcagaattatgcttcaattccagaaaggaaagcactggggtagatacaaggttggggctggcagaagagtagcagttcagagatcattaacacttgatccatttaatttcccaggtaaccaaagacaccatggaatataatctgcctccactaaagtgtaccttttgtacaataaggcaaagaaaaaataagtacacacctaagctctagacttttgttctatcctctctgcattttcggtgtggatgaatacaacttgggaagaaaggaaagaagaaccagcagttttaagcacttactatttgctctgcaaagtgtattcatcaacattgttgctttcaatcttaaagcatggattggagacaggcagtattacccacacttcatagatgcagaaattaaatctcaggctaaggaggaaggaaaagggagttcaccaaataagcaggagcctacctgaagcctgatgcatctggtcctagagccaaccttccatttccccccagcccccacctgtttaagcttcgaggccagtgggaggagggaggggccaggcagctgagggccaggaaagatgtgaaaaactctagctggtgaccgagaggaggagtagagtgtgcccttagttcatatgaactagagggagttggtatttgcacagcagtcagggtcacatgagtgatcatggtacagtgagaagttctccctcccagggccaggtcacagggtttgtttctgttcaatccggattcttccagtaaaagcttcaacttcccacactgaagctgagagcctcccaaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaaggtaagaatatggcttaaaagaaattctgtacctaactcgttaatttattttttaacctttagccacataggtgtggctttacagatgcatttattcaaaccagaaaagatcctaagaatctgataaaataatataaaagagttttgttaacagcctccagcctaaaaattcagacctagaaattcaggacccccctcaaatcacctccaaaagctctctctcctgtaatactatctctgtctcccaccctgatcttttcccaaataccctccctgtcccatcctcctccagggccagctcaacttctctggccaagactatttcttcttccatgacagccctcctcttatgccagccattgactaagacacatgctgggcctgcaaggggactgaaccagatcctgtgctccaagggtccagacttataagcaagtaattgtaggacgtggagtaagacctataaaatttgcacacaaaatactataggatcccatggaaaggagtgattacttctgtttacagagtcagggatgcctccacaaaggaggccatagtgatctggcctgatatgatgaaaatgtccctgctggctgctcaaggggaaatgtatgtgtctacatgcctgactctccaagggcaggaaccatgtgctgatgtggcccagcaatgaggggcctggggagggtgagaaggacttgggacttctcctgtgggaactggcagatccctctgctcccactgcactacccagctgcctcaatctcttgctgcatctccttctcccagctttagccaggttctatcactccccgtgcaggcctccaacaagagcaatacagtgggatccatagttcactggacagccaagcccttaaccgccctggtcctcagcagcagcaggtgcccttccacacatgttcacagctgtgcccaggccctcggtcatcagctacctgcccagagcacaacgcctaccacagagttggtcaatgtgttgcgtggattattctcagggcattagttcaaggccagagccctaagctcacatgtacacctgcctacaggtgtacattgggaagtcccataaatacatcagactcaaccccagaattggactcaccatcccctcacccccaccctatggaggaccttctcactgtgtccttacatggtctttcctccatgtgcacacatccctggtgttgccttgtgtgtcctaatctcctctcattacaaggataccagattggaataggtctcatcctagcagcctcattttaacttaatcacctatttaaagacattatctccaaatacagccacatgctaatatactatgaattaggacttcaacatatgaacttagagagacacaattcaaaccacgataatgtccgtcttagtccattttatgttgctataacaaaatacctgaggctgggtaatttataaatataagaggtttattttgaatcatgattctggtggctgaaaagtccaagagcatggtgctggcatctgctcagcttctcgtgagggccatgctgcatcaagacatggtgaagaaatagaaaggcaagcaggcatgtataaagggaccaaactcacccacttctgggagatggcattaatctactcatgtggaatccacccttatggcccaaacacctctcacaagaccccgtgtcctagcactgccacactggcagttaaacttcaacagagagttttggtggggactaaccacatccaaaccacagcagtatccaaaaagtgttttgtagttttatgtttatatatatgtatactttttgttcataactatgtataaacagttttctatcactatcactgccataacaaattatcaaaaatttagcagcttaagacaatacaagtttattatctcacacctctgtaagtcagaagtccaaacaggtgtctctgggtaaaatcaaggtgttggcagggctgcgttcccttctggagggtctgaagaagaatcccttccaagctcattctggttgttggcagaattcagattcatgtggctgtaggatggaggtcccatttgcttgttggctgaggttcattctcagcttctggaggtcatgccttgtcttgtgttcccctttgtctctaagccatcaatggcaagttgagtcattctcatgcttccaaactctccagccacttcttctgccacacgactctctgactgctcttctacacccttgtccacttttaagtgcccttgtggtcacattagacccaccgggataatacaggacatgctcattgccttaaggttcttaacctaaattccatctgcaaagccctttgccacacaatgtaatgtattaggaattaggacgtggacatctttagggccattattctgcctacaacaatatacatttgaaaaagacagatagaaatacatcaaaataataacaactcttgtgtgatagatgttttccttgtacatttggactgtttccaaagtttctgcaatgtataactttaaattcacaataaaaaaaaacaagaggcaatttttaaagaaggaacataggattcgtatacagatgttggctgcgatcctgggcaagttattgatcgtgtgactctcagcttcctcacatttatgagggtgataattattccttcctaataaaattgtcatatgaattaagaaagaaaaagaaaagtccacgaaggacctaacatagaaggcctgcaagaaatgtttgttcttatccctcctctcctgaatttgatcataccattatctcaggagtactgtccaaactccaccttctttgatgtattataaatacaactgcttctcatatttgaaaattttcataaataatttgtctttcgttttccaaaaattgtcttcatcttaaagggctcagctcaatctggaagcagaagccaccatgaaaactgccctcactaatctgggcacctagttttctcatccattccatgaagcagctgggccagattattttattcaacctctagcaagcatgtactgttacattttctgtaaggaccctttcagctccgaagttctatcactcattttcagcaaaagttaaaataaattaatgtatacaaggcctcagcccagcgttggcaaattgacgtgttcgataaatgttagcttttaactactatttcattagtagtagtagtaataaatgtcttctggaaccccagtagccagttatccttgagtaacagtgatttacatcttctgctttctccttttggtgcatttaaaagtcttccctcaatacaacaatgacaacacacacacacacacacacacacacacacacacacacacacacacaatgcaaaactgggcaaagcagatatttctcccacaaatggccaataagcatgagaagatgctcaacatcattagacattaggggaatgcaaatcaaaaccccaatgagctatttatcaccgcacaaccattaggatggctattatcaaaaccaaaaaaacaaacaaaaaacacaagaaacaacaagtgttgatgacaatttggaaaaactggaacccttgtgcactgcttgtaaaaatgtaaaatggtgcggctgctgtggaagatgctgtaacatttcctcaaaatattaaacatagaattaccagatgatctagcaatttcacttctgagtatataccaaaaaaaattgaaagcaataattcaaagagatatttgtacatcgatgttcacagagacctaattcatgacagccaaaagtttccatcaatagatgactgggtaaacaaaatataggctgggcacggtggctcacgcctgtaatcccaacactttgggaagccaaggtgggtggatcacctgaggtcaggagctcaagaccagcctggccaacatggcgaaactcggtccctactaaagtcacaaaaattagtcaggcatggtggcgggcacctgtaatcccagccactcaggaggctgaggcatgagaatcgcttgaaccctggaggcagaggttgcagtgagcagagatcatgccattgcactccagcctggataaacagagtgagactctgtctcaaaaaaaaaaaaaaaaaaaaaaaaggaaaggtgtatatctacagtgaactagggaaggaaatcccatcacatgctacaacacggatgagccttgaagagattaagctttggatcaagctttcaattaagcataagattaagcttaattaataagacattcacaaaaggacagatgttatgtgattccacctaaataaggtacatagagtccatagagacagagaataaaatggtggttgccaggagctgagggagggggaatgggaattattgtttaatagatacagagtttctgtctgggatgatgaaaaaaattctagaaaagatggttataatggttgcacaacaatgtgaatgtacttaatgcctctgaactgtacacctaacgatggttaaaatgatcaattttatgttatgtatattttaccacaacttctttaaaaatctcctctattcttttcccatagggaccccaaccctgagacactatggccctgacctcagacctggggaaacagataaaactgaaagaggtggaggggaccctcctgcagcctgcaactgtggacaactggagccagatccagagcttcgaggccaaaccagatgatctcctcatctgcacctaccctaaagcaggtgattgcagggtaggagggacagcaaagacctgctgagccagcacaggctcatcacttaagttagaattccccttcttaggaaacctgctccttcttattgttccacaatgggttttggagctcagggctcacacaggatgcctgatatccgagttttccaggaaagctgctatgctctaccatgcactggtcttgggtggagagacccttgcctgtgctgctccactccctacagagatccaaagtccatccctcatggacttctatcactcatggcaaacaggattctgacccaaggggagggtgatgcaaacaccaaggctctacatcctcttcgtttactcgggactcttcagggaagattgtctaacagatttctgcttctcatccttcctttctgagcctcagggacaacgtggattcaggaaattgtggatatgattgaacagaatggggacgtggagaagtgccagcgagccatcatccaacaccgccatcctttcattgagtgggctcggccaccccaaccttctggtgagagcacctccctctttctctcttcctgctttctttccctctctcttctgttttcccctgtcttttctcacttttctcctcttctctcctctctctctcccccatctctccttcctcttctctttctctctcattttcactgtcatatgtttcttccttttatcttcctctcatcctctgtctacatattatttaagattttttaccaaaagtgaatcaccaaatgaaaaggatgtgtgctagggtcagattctgccttattttcttcttaagccctccctctgatcatgtgcaactgtagatcacattgaagatgtgaaaaactgtaagccatttattccttcttctatctgtaccccaacctgataaaacccagtgcagccaggagggtatccaagaatcgataattcacacacacatacacacacacacacacacaccccattgcatttggaaccaattatttctgttcaacagagaagacttttcaggtaatgctcaacctagaagtgtttctcttcacatcaaaaaataaagaaagctaaaaaatataaccagaatgctatatttcaggtaactggagctgctggaactattttgcaaaacaaggataggaggaaggcctacttccctaagttatagcattgcagagatccatgtgatagaaagctgggagcacagtagctgaagctatgaaaatgtagttaatgcagctctagcatgaagtctagacttggagcaactgtagacagaggtctgataaatccctaaaaatgtcctaagatagaaattccctgatctgatgcatacaagacacttgtaacctgtggaaggaggtgtctccaagtcagaatagccttaaaggattttgctttcccctatgatcctaccatccagcccctctggctcctctggctttcgaagaagagaaaatggtcactaggtaggtaactactcgctttgtaacccagtgcctgttcccgccctgctctgaaatacctgtggggctctgaccccatagacaggccagcctctgcctgcttaaccatgatctcactccatgtgccatgaggacctgctgttttgtgtgtgtctggtcttctgctccttgagcagcaggatggtataatagttaaggactaccagggtttaaatcctgactccatcactcacctcacaacgtttaaatcctgactccgtcactcacctcacaatgtttacataacctctctgtgttacagtttccttagctgcaaagtgtagatagaatcaaggcctatctcaaagagttgttgtgagcattaacaaattcagtataggtaaaaagcttgaagcagtgcctgacactcagaggatactatctacgtgttagctatctttactaaccacttctccaggccccatgaccccatgtgttccctgattatctaagaccagcattttttgtttatttaaagatggaggctagctctgtcacccaggctggactgcagtggtgccatcataggtcactgcaacctggaactcctgggcttaggcaatcttcccacctcagactcctgagtagctgggactacaggtgaacaccgccacacctggcaaattttttgcttgtagagatcgggtttcactatgtttcccagattggtctcaaatacctggcttcaagcaatcctcctgcctcggccttccaagccactgggatcacaaacatgagccaccacacccagcccaagaacggcttttgatctttgttctacctcctgcccctgccgctgcccagtgtcttacctctggcaatttgagagattaaagaaagaggagaggcctaagcaagatttctaatgaagtattcttagcagtagagagcagagtgttcaatcactaaatcggcataaaaaccaggatagagctgtagaatccagagaaaggatggtaatcaaacggccagcttggcatgtcatacagaggcaccctggcctctttaggaaccaaggtgccctgtgtgagaataacaaacagtctcaggctttatgatctgcccagccacagacagctgaatgctggctggagactcagctgtgcagtggtcgtttgtttggtttttttttttgagacaaagtctggctctgttgcccaggcaggagtgcaatggcatggtcttggctcactgcaacctctgcctcccgggttcaagcaattctcctgcctcagcctcccaagtagctggaattacaggcacctgccagcacgcccagcaaatttttggtatttttagtacagtcagggttttaccatgttggccaggctggtctcgaactcctgacctcatgatatacccgcctcggcctcccaaagcactgagattataggcgtaagccaccgtgcccagccagtggttttctttcagagtagataatccctgccagttgaggtgaggagcatcactgggaggagaccagttgctgacatagactcatggctgtcggccaaaggtctcaaccacccttggagcattctggagtggtcagacactactggacaatggatgagcttgtgccctgcatggtcagtctcccttccaggcccccttctgctctcccatcaactcccagccttgtagccgttctgtgacaaaagggattacatctgtgacccacagagaattggtttggaaagactttgaaaagacctgtgtgcatgtgtatgcatatgcatgtgtgtgtgtgaactgtatataggtgaaatctaggaatgatccacttagtttcagcaaacatctatgctcaagggcctatgctgctcataagacttcacacctacttgccctcaataagttattgtcccatggaagaaaccaatgcagatgatataacaacaagcatggagggctactggcagggtgaggggaacatggccaatgaaccgttcctggaggtgacacctgaaatgataaactgttgtcattactaattttctgcctctgtctcctgccagactgcaaactctttgatggcaagaaacaagttctgtttaactttgtactcccatggggctgtttctacagtattggctgaattgatttatccctcacagccacatgcaatttggctcaaatcccaaggctaaaatcttagtgcaactgacgaaggccaaaaatgaccccgtttgcccccttcttccaagctagtgggcttgggaatgggccctgcagcctgggctgtgtcatgcacactctccacgctgtgcttctccaccctgagtctgagcaaccatcgtggtattcctggcgggtgaggcaaccccatggggcttttctgaatcattgatgagagagaggtggggcgagggtgtgggggggcagaatgtacaatgtacctatgttcataaaagaaaacactggtcaactgctttatgtcaagccccgactccacagtatctctctcctgtaggggttttttggcagaaaaatttggagttagagctggactgagcccaccaacagggctggatcaggagtaggagtgggccttcttatttgtcatgggcaggaaggatgactgtgagccatctaaggaccataatgactgagtacagatttcccaattagaagactgggtctcttttaggcattaagtggttactgcccacagggcattaaatcaggtgtaataggaaagaggagagccgcgagtaccaggaaggaaatcaaccagcctgcagatctcactttctggcagattccctgaatttgctccccagcttgggattgacagtccaactccatccataaccttcccttctgtcctctatgtctgctaaggtttcttatagctttcatctccgtttctctacattgtgcttctttagctctgccactatttttcttttcagctatataagctctgctatttaaccctactcattgtaggttttcatgtccaaacactataaatcttcccagtctttttagtagtctcttgtttccttgctcatgttttcaactttctcttttattcctttgcacttttttttgagacagggtctcactctgtcacccaggctagagtgcagtagtgcaaacacagctcactgcagcctcaatctctcgagctcaagcgatcctcccatctcagcctcccgagtaagtagctgggactacaggtgcgtatcaccatgcccagctaattttggtattttttttttttagagacaggatttcaccatgttgcccaggctggtctcaaactcctgagctcaagcaatccacctgcctcaacctcccaaagtgccaagattacagacgtgagccactgcccctggccttctttgcatattttaaacatagttatttatattctctattaggtacccaataactgaggtcactaggggtttagttcttccacctgttttttttctagctcttgttcatagggcttttccctcatttgttttgtaattttgtataaaaagctcttttctccctgtcttgatctcacacctacattggaacatttccaatctagaatagtttaagttaacttctggtccaagctggtagtataatttcatatccatgcatgtagtatgaaaacaggattgtggttatgagttctcaagaaagcctctttttctgcacccagaggcgaggcaaggaaattaccttacctctctttggcagtaggtgatctttttctctctcacctttcactgaggtagcagacatttgagtttctccggctaatgcatgggtctctgttcctaatctgtgcctcactaaagtccagggctaccagcctcttccctgagcagaggtcactgaactgagcactgggtgtccagagggtgaacccactcagggcagctgtcatcaaagcctttgcccacttctccatcttgcagctccctccctcttcactttcgtccctggagggtccccttattttcttatgagcctgattatgcacttaaatgatacgtttggtgttttaatcagaatctgcaggtgtgtgattaacaggaaagatcttcataatgttcaggccaccatgtctccagcagtgaaagtacttggagagacccttgaagagtgagtgggactgtccagatgtgtagaaatgagagccggagggagccacaggggcgtggggcagcaggaccagggcatgtggaaggtcagagtgtgagctggcgtagaggtggagctgagaaaagagactagaggcaggagagctttgcagttcttctaaggaatatggacttcaaaaatggttaaaggtggttttccaacttttctttttagtaccaaaacacttttttatttaacaaaaattaccatgactacatgatccagcaattccacttctgggtatatatcccaaagaaataaaaacagggtctgaaacagatacctgtacatctacattcaaaataacattattcacaatagccaaaaggtggcaacaacccaagtgtccaccaatggctgaattgataaacaagatgtggatatacaatggaacattactcagtcttaaagaggaaggagattttctgcactaacttgacccagctcctctgacatgattcgcatgagcctctgattcccacactagagtggaagctccttagggagaaggcctgtgtttttcttgtctttgttgccttttcccctaacctcagcttaacacgatgattgcacaaagtgctcgttaaggcttttaaatgagagagtagaggccgggcaccgtggctcatgtctgtaatcccagcactttgggaggccaaggcaggtggatcacgaggtcaccagatcgagaccagcctgaccaacatggtgaaaccccgtctctactaaaaatagaaaaattagatgggcgtggtggccaagcgcctgtaatcccagctactcgggaggctgaggcaggagaactgcttgaacctgggaagcggaggttgcagtgagccgagatcgcaccactgcactccagcctggtgatggaccaagactccgtctcaaaaaaaaaatgagacagtagaaatcatgactcacaggccagcaagtatacatgtttttagagatgaaacaagtgattgcaaacaggccgggtacatgagacagcctgctgcaggcacatgggggtcatctctggctggcaggaaggtgagggagtcctctcttctctggtcctggctgactctgcctcagcaggacttcacttgaccattctcaccttctgtcacctcatccttaaagtgacagagtaaattaactctaaggccccatccaggactcaagctgtgtgattttacaaaaatgaaaattatattaataatcccattgtaaaatcccaaaagaaagtcaagagactagcagaaagacaggtgggtgatgggatgtcctggacagagcctggatcatgaggtccccatgtagtgcttgtactacgcagatgtttcctcttgagctattttaaaggtgtggaaaaagccaaagcaatgccctctccacggatactaaagactcacctttccactcagctgctgccaccgtctttctgggaaaacaactgcaaggtaagataccaacagctccctgtgacagaagggaaagtaagccaaccaaagcgagtcctgcagaccccaacgcagagcattcgtgatcacctttgcctctccactgtctctgatgcttaccagcaaagagaaaacataaagttctacattcagcaggacattcacctgaacagtttcaaataggacatgaaggcaggatccagattgaatgtttggagggaactagagacatggggaggcagtgagtgcagtaagcgtagctgtgaaatgaaggggagaagatggtggtcccaggctgcaggccatggggaggttttctaacagaccagggagggaagaatgagaggaaaaaagctaaagctctccccaaaggaggccaggcgcggtggctcacgcctgtaatcccagcactttgggaggccgaggcgggtggatcacaaagtcaggagatcgagagcacggtgaaaccccgtctctactaaaaataaaaaaaaacttagccgggcgcggtggcgggcgcctatagtcccagctactcgggagggtgaggcaggagaatggcgtgaacccgggaggcggagcttgcagtgagccgagatcacgccactgcactccagcctgggccacagagcgagactccatctcaaaaaaaaagttctccccaaagggtaaacagatgaatcaggcagagcaacgctcttgaggacaccccacctctgcctctggtagactctgagttcttcgttttatttattctgtgactttattcgtatgcaccccagtgcctaataagttcctggcacatagagggcattagacacgtccttgctgagtaaatacggaagtggctgtagagcaggtggagtcaagggtacaaactgagccgccagccttggtgagaaagtggggcactgcttccttaaaggcaggaatgaaggggaaagaagggctaagaaagatatgttgctaggggactggagtgaagttggaggactcaaatgacttcactccttttagtaataatgttggataaggggacaaaaacttccatttccagaattatggcaaactaggtgttctgaacccctgaagcccttatatgtagaacatccaggattactgcataaaaaaatcacaagtttccttttaatgcataactgagatcaaaataaagtccctaagtttagaaactgcagaggaaactgaaactcagagaggcaaattgagactgggactctccaggggaaatctgatgacctggataatccagcaatttaagttttaatggctgcacagggacagggtcaaagcccatggcacaaggaaccagaagaatgaggagccaaagctgggaccactgaagggctacatcctcaatggatgggtggaggaggcagagaaagaccttagggaaccactctgccttgacctaggcgctcagctcccttgagaatgtatagccacaggtttactccctcggggtttgagattgaaaattgcactccttgcattgtccaagaaactacaagcagagacattccacaaggtggtccccacagccagtgttcccaggtccgctctggagggacacagctgcaactcagacccccataggatccccacttgagctcaccatcccacattacaaaatacacaaaagaacaagccaccatgagatgcagtcttcagaaagaacccatggaagagtcagacctcaagaacttcagacaatgtaattatcaactctagaaataagagaaggttcaagttgtgtgaataaatgaaaaagtgtatcaaaaataaaataaagaaataagatgctacttttagacacagaaatattaagtaaataaatggaatttctataacaaaaaaatataaaatcatggaaattaaaaactcaagcataggataaagtgcagaacagctgcatagagaattagtgaactcagacaggaaggtttgagggtaaaggtttgaggagagaggagagacctgtgtctggagctaagagccaagagatggagcacgggagggattaataaaaggattatcaagcagcaatgaagaggaagaaaactgagcataaaaaatttagaaactaggggaattttttaaatcagcatttcttaaaaccttctttactggtgcttggcagcttggtaagttggagaagagaagatggggagtaggacttagtagacagtaacagagtcaacgctttcaggagcagggtttctcaaccttagcacttgctctaaagggcctgggacttgatataatcaggcatggcaagacatgcaggtacagtggtgactgtcataaggaagaagtgtgtcctcgcagatacctagaacaggaggcatggcatgtcacacagagcctcacagggaagcaatgggatagatcaggaggaagagacagtgagtagaagacatgggcaagagccttgatgtggtttctttgggaaggaatagttgaggcaaggtaggcaggcttgggattggccagtttgaaccactggagcaggctttcagccacaggggcttggcctagtggtctggtatctgaccctggggtgtcagggcaggtgaataatggcccagtgtgtaaaagcccaacagtggaagtgttgggggtataggctctggggtgttgtaggcagttcctccagagtcagcaaagccccaggatgtcaaagcatcagatacagaatataaaagacataattaatacagcactcctgacatttggggcagatttttctttcttgtgggtgggagcaaggggactcttctatgtattgtagaatgttgaacagcatacttggcccctgcatggatgccagtagcaccactactccaagctgtgcaaccaaaaatgtctccagacattgccaaatgtcccctagtggatacaatcatcccatcatccccaattgagaaccacttaaaagtgaaagaataaaaaagcacagcattgaaatagctggtcatagatctgagatgcatagtcaagaggcccatttggcattgatgccattaaaatgtgaactgagtactggataaaaggtcagatttggtaaaatgaaaggttgggagagtggagggatgtgaaattgtgggcaaagtggaacttgaaggaatgtttgtaggggcagagctgaaatgattagagatggaaatcattcaagccgaggaggccaggagaaaaataggagctattttcttgctgtgtggctcaaactcttaaacatgaagcttctgtgcatctttgggagggtgcgcgaggggtcatcagtttacgttgatactgtggaagtctcctattcaagtggcaggtcatagtttacagaaaaagattttgctcctgataccaaaggggcaatcaggcaatctaatcctcaccaatccctaattgattagctaattaaaaggactgagtttgaagtagagagcagacttggtgacaaagcagagacagaaagaagagggaggtcacaaggccaagtcgcagggccagcactgcagaactgagccagagtgcacagcaaccctcaggatggctctgcctaagggaactctgtgaaagtccactttttataccatcttttacccacctcttttcttaccccaaagttcctttatgtagctcgaaatgccaaagactgtatggtttcctactaccatttccaaaggatgaaccacatgcttcctgaccctggtacctgggaagagtattttgaaaccttcatcaatggaaaaggtacgggaacatccttcacacccttgcattctcactccagctaggctgggtctagggaaccacaggcagcattttatcccctagaatgcctgtacttcatcaggtgtgtcctaccacagactgggactgggcagagcaagctggccactgagtgtatgcccacagccctcagcaaacatcttccacctgattcagagtctttaattacagccatcctcttccaaaaggtgtccttgtccctatgtgattgcacataataggaagccactttagggacgatgttggggcaagtaaccctaaggctgtccccatctacaccaccctcaaaatcaaacagatcagaacccttaggacatatctaatacagaatttgggttttctctctctaactcacttcaggaaaatccctaatactcagaaggttttgtgtgatgcctatgtagactattctgtttcctgtgtctatttcagtggtttggggttcctggtttgaccacgtgaaaggatggtgggagatgaaagacagacaccagattctcttcctcttctatgaggacataaagagggtgagtgaaggctctgcagaagaaccattttaaagtggttcttcaggtgcagagaaattcaaagttgtttcaaaggacatcccagagaattgtagtatttctttatgatactctcattcattccagtccaatgttacccttgccgcaggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggtgtgtggggcctctttatcatacattcagattgtctcgtaacatcctgtctgcctcttagcagacaatattgagttttattaattccaagccaatgcatttcaactattcctaatatgtgtttctaataaaaccagggatttgatcctgttgtagaagagagctttctagggtattgttccagtatttggttgcaaggaacagagagtccctcaagctagccccaaagaaaggggcttactgtgaagattcaccatggacaataaaggaaatgcaatcacatagaaaactaggaagaggagccaccactggtccagacctcccaggggccgctggatctcagggtccaggactcagcagcaggagggatgtgtctttgctccaaagctccaccacttacaggactcagctgcttttcacatatctattaggcatggcttcctctgctaaccagcttccggtctctccacccattacaactttctcccactttataacttctgatgactcagtttctgctcataacttggtcttgacccttacccaaacctgctctacttcatgagtttcaactacaactactgttgagaactgcctcatcctcagtatttcttagttccaattcccaaaggaggaattctaactggcccatctaatattttttaagaaaaaactttatcactttctaatttaaaaagcaaaacatgtcattgttaaatattaaattgggctgggcagattgacttatgcccataatcccacgttttggaaagctgaggcatgaggattgcttgaggctaggagttcgaaactagactgggcaacacagcaagaccccatctctacaaaaaaaaattaattagctgggtgtggtgatgcatccctgtattcccagcttctcaggaggctgaggtgggaggagcacttgagcccaggattttgagaatgcagtgagctaggaccttgccactgtactccagcctgggtgacagagaaagacaccagcttttcttaaaaaataaactaaataggctgggcatgatggctcacgcctgtaatcccagcactttgggaggcctaggcaggcagatcacgaggtcaagagatcaagaccaacctggccaacatggtgaaaccctgtctctactaaaaataaaaaaattagctgggcgtggtggtgcacgcctgtagtcccagctattcgggaggctcatgcaggagaatcacttgaacccaggaggcagaggttgcagtgagccaagatcatgccactgtactccagcctggtgacaaagtgagactgtctcaataaataaataaataaataaaatcagtataaaattatattttttaaaagtctctccacaaaaactccacccccaagaagtaactaccaacagtatggaagtccctttctctctcatttataacatacagattttttattcacaacagtgaaatcatggtatacacactgctttgaaacatcttttcttcttcctctttgattttgcatgtgcttgaatttatgttgttgcattttccaatctacaacagtattccataccaatgaaacaaaccaaaatattctaccccttttctctttggataaccagtggtaatgatttgtcaaggtgcccttcttcaggctcatacataaccatctttctatacaccctccttcttcagactcacacagacacaaagatatgtaaccataatgaaagcttgctccctaaaatgcagaatggggtcatattttatacctttacttaccaggatatgagaaacccctctagggcaaggcatatagactcatacacctcattgatttctttggtcccatgttataccaagcgaaggatgcatcataattcatccaactattcccttaatgatagacactatagttattattgttttcaatgtttgtttttatgcataatgttacagtaaatatctttgtgcataaattatttccagatgcttttatttctgttgcataatttt

SEQ ID NO: 14336 - DNA, 19733 bp, Human
gccacatccactaacccttcttttcacaaaagatttctgtttagcatacatttttgtttgatagcaattttcccatagtggtacttctttcaaaactggaatcaatcctctgaaagtctaatgctgctttattaagtaaatttaagtcatattctaaatctattgttgtcatttcagcaatgttcacataatcttcaccaggagtagattcaatctcaagaaacaactttcttttctcttccataagaagtaactcctcatgtatttgttttatcacgagattgcagcagtttacttacgtcttcaagttccacttctaatttgagttatctttctatttccaccacatctgcagttatttcctccactgaagtctttgttatagggccaacaggttcatatgcccactctgcaataatagaccaattacaatgagacattatgttttgcaacaaagaaagagtataataattggagggcactgagaaggaagatagttggaggccctcaaacttacctcctcaaggaaatctgggctggagtttttaaggggttaatggagggtgatggactgaaaaattggagtcatagattagtcaggataatgaagataaaatcagtaggagttggaaactgcattctttggtgagtcagctccttgtggggtccttgagagcagctggcatcagggaggtccctcagaccagctgagtcagtagtttcatcagtatgctggacctgaaggaatacctcaaagagaaaaccacatttcaaaatgtttaagttattatctatagaacagttaagatgaactttaatcttgtaacaatgtctgcataattctaagacaatagccaaaaaactattaggaagcgagtcagagagcaagctaatgtaataattaatactgaatgtactacaggcttggtttacttttgtttttttttttcccctccctttgtccttcattaattcaacaaagtctataggaatagtttcatcttgaaactctctaaatcatacatgatggttgtaagaatcaacacgtaaatgctatatcataaatgaacctttaaaatattatgctaagtaaaataagccagccataaaatatcacatattgtgtgattccatgtatttaaaaaatgtccagaataggcaaatctatagagacagaaattcaagtagcagttgcccaggataggacaaatgcagaaagaaggggtagggagtaaaaggctaaagcttatagggtttatttttaggagataagagttctctaaaattgactcttacggtagaagcacaattctgtgaatatactatgaaacattaaattttacacaataattgataatttgtatgatatctgaattatacgtcaacaaatttacaaaagtttttgaaccacatttagctattttatctttagttctgtgtcaaagagactgcaggaacatgagcctctcactgctactcttatgcacactattctgaaatatattacatgagtcaggtgatgagtccatccaagatcattgatattagctgaattacagcacttaaaaatctagggctgggtgcggtggctcacgcctgtaatcccagcactttgggaggccaaggagggcagatcacaaggtcaggggttcgagaccatcctgccgaatacagtgaaaccccatctctactaaaaatacagaaaaattagctgggtgcggtggcaggtgcctgtctgtagtcccagctactcaggaggctgaggcaggagagtggtgtgaacctgggaggaggagcttgcagtgagctctcaaaaaaaaaaaaatccaaaaagaacattaaacgcacttgtgtaaacaggtcatctaccttttatttgtctctttgtcatccacatgctcagactgttaatataatgtatttactttgaagtgtaaaagttacattttaacttcttgactgatttatactggatgtcaccatgagaaatgacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggtaagtaacttttttgattggtaacatgaagatctaactttcttgtacctttgaagctgagtttgtataaagccataaagtcagggtagtggggtatttttgtaatgaatttatcaaatgaaattgtaagatgatctaccaaactcacaagcactatagaaaatgtaaattataggatcagttaaaactctgtggccatcactcatacagaagactccaggaagtcataagcctgtatattagtgcacctaagatttctttaagcaatcacatatctgttttattatacattttttcatcttaaaaaaaagtcagacttattcagaaacatcttgctgaatgcatactggtagattgagtagttacacattttttagaactatctatataacattgcagaaattgttttttcttgtatatttcagtcttattatttagtaattgcaatatgtacccatgttactagaacgtttcctccacagttgagagaaatgatgtctccatttcagaatcaaaaaccaatgcatgttatttgaagtttccagtgtttctattccttcactaaaggattggaaaccatttattttaaggctaatcatcttgtcaaagtgtgaacattaagttacaactgtatagtttttttttgaaactatgtatctttctttaaaaatatgagccaaattaaggttgaatgcaaatttctgtttcaacaagttctcaaaattttctagctgtaatttgcaaacatatttacctaaaaactaatattattatgaggttagcatgactcaaaagcagtagtaggtacaaggatttcagccatcatttcaaaataatcaacagttaacctgaagaaccaaagataaaagattagattaatgaatgggaaattagactatttgttagaaaattgtttttatgggtatggtagaattaattgatcacggagctcaaagagtggtttatacgtatatctgctactatcgaaggtttacaaaataaagaaatggagattaattctctatggcttgtttgtgattgtgaatatactgatgtgacatgagggatgcagttttccctcatgattctctcaccactttgcctttcttgtaaatacacatgggtaaaatatataatacataaaaattaaattatgcctatatacgaatatatgtattttttttcaaggcacaaacactttgcctacatttttgcccacattattctaacttctttcagaaaattacctagtttaattatcttgtgtcatctatcttttctttttttttcccccatcaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatgtaagaaggtactggccattcattcaaagaatatttataaagagattagcacacaccacaggtacgtgtatgggacacagtttctatcccaacacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcaggtagcagatgatggaaaaatggactagaaagtggatagaattacctatgcctacttttacagtaatatgactaacttcatattgtgttgtgtggaaaaaagttaatacaaataaaccacttaaaatgtctctggcatatagttagtgattcagaaatattattttgcaattatggttatttttgttattactaatactatgaattacttaacatgtgtaagtcacttgagatattattcctcatttaatagaaactaattattcagcatttcaagattatattctctaacaaagtcctatggtcttctatatgacagataccctgtagacttgtttaaaataagacatatcagttttgacagtaagatgagcaaaatgaaattgtaaaattctaccacaagtgacaaggatcttcatcagtattctaacttataagaaaataatcccttaccgatataaatgtgtgattctattagtatttgcagccagacccagtgttcacttgattttactaaagcatttaaatcattctgcgttgagatcccagaggtttacatcttagcataaacataccctattagagcaggtgttttctgccttaagacaagcaacccagtaaagcttcctgggatagcttgtgtctcaacatcataagtgcctgagagagaagcacagaaaaaatgaacaacgcatgtataataaagaccaaataatttctaccactcgtatctgaatcgtgccctcagtttacaataataaaagaattctgtcatcatataacattatattctttatggaggaatataagaatgtaatatattttaaattgatatcacccttctaagaaataggtagaaagtaagcatttttattacattatgtaatctcttaagagataatttttgcctacctccttattaacagcaacatgaaactgatattttattccatggttaaaatccaatatctatgttgaatgcaaattgtatgggctttatatggtaactttctaaagagacaaaagctgagataagactaatgaaaattctgtcccaccctatcctactcttgaaagatttccccactcacattaagggaaactgacagtgccagtaagagggagaagagagtacgaggtgtggaaggataagaaaaagattgagtcgtagtacatgtgataattactaatactagctgttgttactaacttgtagaaagctttgaatgcaagtcaatggttgtgaaagccattctctaattgtttatcatgtaaaataactgcaaacccaatttgctttctattcaattaaatattagattctcagataatttatgcatactttaagagaaaaggacacttggcaaatgtattaagtattaaaaatgcatatagccattggttttataatatattcacatgaaatcatacagagaaaaaataaatcaagatgtacatatttaatatttatggaaaatattcataaaataaacatcaaaagtaatcaaacatctgaaattaaggaataattaaaaacatatactagatgcatactatagcattacaataattttatcaataaaatattcagttacagtcagctataatacaagtaaagtgaggtagaaaattataaatattacaggctgacacgttttttgtaggaggaaaaggtatatacaatcagaataaaattgtctaaataaacgtcacaagtgtacattgaactataaagatagaacaaaagccatgatgaaaacatatgtagtttacaaggtgacatctctcgacaaaaattttagaaaaaaaattattttctttttagaacttgcactacttctataaaataccttacatacatagtgtattattattttaaagttgtcacagaatgggaaacaaccagtccacatcaataatgaatcccctttagggattatattactttaacactgggtggatgaaggcggctctggacatcaagccactgaaacaaaacactgaacgtaagttacatcaaatgtggctacaggtaactgcaattacgcacaatacctggatatcctatgtattaccttgaatagcagaacaatgactctaacatcattaacactgatgtcttaagattaaaaatcatattttaaaaaatgcttagccatatgtggtctgcaaataaacatttggaatcttttttctttgttttgtagagaacacttaagaaaaagttttaccccaatgattaaatctgaaagtatttaaatttcaaaattggcgtacattggggaacacaggtcagaatgattcccagtaaattccagccaagtacatcttcactaagatttttatgtagtgtgggtgatctactcaagagggtgaccaaatctctgcagaaagttctggcagtctctcgcattctggtgcaagtgctgctgcctctgagacacagcaaaatgatgatgagaattcctcacatgcagttataaatagcacatcaatttaacagtgtgatttcagggaaaaattgttccacttaaacaatcacctgaaaaatataatcattcgaccatgtaactacatactgtacgattctgtattacaaatgagaatacagaattatttatagaaatttatagaaattccaaaccacaacagcagactccataatgtcagtgattcttaaccaccaccttttacagctacttttttttctcttttgaaaaaagactggaaaactctgacaaactttaagtgaagtgtaaaggattatagaataagataaatgtaggtttacgtaatcccagctgtgagtaacttttcctcagtgctcagagtcagggaagtcaaccactaatgacttcaaactaaaataattctgtagaaaacctgcctaaaataagcatatgtgatttagcgagcaacaatatagcattaaagccaactggtgccactttaaagaacctatattagtacttataatatgataagtgaagagtttgggtatctcctcaaatactgtgtaataactctatttcatttctccctttcacaaacgcacacacatacacacacacatatttacacaaagacccttaacagaggcaacctatctcatattatacatattgcaaaaaaaactgagtaattgagtcagttaaaaaacatcctttactccaataattcctgataaaacttgattttctctctttttataacaattctttcacagtgcttgctgtgctgataatctattatgatagaacaaattcttttttttcacaggaaatggaagagtttgtccagagctctggagaaaatggtgttgtggtgttttctctggggtcgatggtcagtaacacatcagaagaaagggccaatgtaattgcatcagcccttgccaagatcccacaaaaggtaagataaaatgttttaatggtgtaaaaaactactgaaagaggctgttaaagtttgtaaagaacccaattgtagaaacttcctgcctatatattcagctgttgggaaagcactaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgatactggggtcaggtaagagctatcaccaaattctgcccctgtgatttgatccttttgtttaagaactcctgagggcgatgtacatcctacaggtgttagaaaacgttacattttaatgagtaacttcactagcacaataacaatagcaggtatttcaaaaaggctgacatgcatcatgcagtttagtgttgccatgttacccagcctcgtgtacttcctgtacattttggaataggcctattcaagtgatattcagggtactattcagagaaaggaaggcctaggctgtcagacaactagtgtaaggatccgcagagctaggcagatttggagaaagagaaaaagcagcctgctttgctggactggacccagccaatgtctgaagtaggcagatgaaagagaaagggtggagatggatcctgctctgagggtggaccctgtgtagtataaaatgtggccccacaaggacgctgcactatgagattaacaactcctcccaatggaggcagcagaaggaaatatagaaaggactcaagcagaaggaagccaggcaggggaacaggttcagatgccccctccatagaacatagtaggaacatattttcttttatatagaataaaatgtgtatttgtcaattactttttagttccctgcctgacatatccttcttgtaatgacctatgctaatattttgccaaaaactcaaagttactttaacactgatgtaacaaatagaacttaaacaccgtaaattatttttttttaatttataaggattccttgggggttccaaaattagtaacttaaacataaaaatgtctcagctatagcaaaacatacgaatcactgttgtcaaaattttgtagcacattttctaagtgttaacaatcaattgaccaaaattcagcaaaatgcaattttgaatttattcaagagttgtatttttatttatggtaccaacaggttccttatttctacattgacaaaatatccaaaattagcaatactgagaatactctgaatttgtgtcaaaaattgtcacttgaaatttttcttggaagtagttcttgataatttgtaatttccaagaagttatacatgctacctttgcagcattaattgacttcttccaagtagcttattttatagacttgcatttttgtcaatcaaaggacatcaaactctgttaaaatgacttatagataagtagatataagtgaactacttcccatattactcaaaaaaatgaataaattaatattaaatttggtagatgaaaactcataaaatacattaaaaaagcatataggtcattagtaaattgttgttgctttttcacactagaattatgactacctaaaatttttaatgcatataattattaaaattttttatctttttaaaattaagttttattttttaacttttaatttcaagggtaaatgtggaggtttgttacacaggtaaacttatgtcttggggtttgttgtatggactgtttcatcttacaggtagtaagactagtaccttttagttatttttcctgatcctttctctcctcccaacccccaccctccaataagccccagtgtatgttattcctctctatatgttcatgtgttctcatcttttagcttccacttataagtgagggcatgtggtatttggatttctgttcctgtgtttgtttgctagggataatggactgcagctcacttatgttcctgaaaaatacatgatcttgttcttttttatggctacataatatttcatggtgaacatgtaccacattttctttattgaatccatcattgatgggcatttagattgatttcatgtctttgctatggtgaatagttttatatagagtaaaatgtatatttgtctgtagtaaacatacatgtgcatgttctaatttgcagtcctttagatacatacccagtaatgggattgctgggttgaatggtatttctgcctctaggattttgaggaatcgccatgctgtcttccacaatggttgaacttacagtcccttcaacagagtataagcatttctttttctatacaacatcacaagcatctgttattttttgagtttttaataatggccattctgactggtgtgagatggtatctctttgtggatttgaccagtgatgtaaacctttttttcatatagtggtttgccacatatagttttcttttgaaaagtgtaacaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagttatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaactctgtctctattaaaatacaaaaaattaactgggcatggctgtttgtccctgcagtcccagctactcagaaggctgagtaggagaactgcctgaacccaggagatggaggttgcagtgagccgagattgcaccactgcactccaccctgggcaacagagggagactccgtctccattaaaagcaaaaaacaaaaaacaaaaaaacaagaacacattctttcatgtccatcccttttctgtgctttttttcttttctgcacatgatgtttccttatctaaattgcacctttttgttagttcaactggtaatcttgtattaattttttcagtctgaagttaaacacaccacatagccttcacttacatctccagcagaagtaggggttccttcctctgaagtctcaaaaacaattttaattcagttcagtgtgttatctaggaaacaccgtcacattcagattcttccattgtgcatttctcattttattcctatgaataattttgctaaaattcatccaatcctaggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttgtgagtataactttttttttactcggtggtctttatagataggttcccttgtgaatagtgagtatgacttttatcctttttataagcgactgatttcgaaagaatttaagtgatttaaacaatctgaaatctgcttttatttttgagtggttatttaaaaattttatttgaaccacatacatttaatgaataatcaattattgaaataattttctacacaaaaataattttaaagtgatatagataagaagacattttaaaataaatttgacgtaatcaatccacagtagaaaggaaagataaacttgacgtaatataataaaatattttaattcaatatctaaaatgtctcaaagtatatctgttttctcactgaaaaatttatttttattatcattattgtaacagacttgataattaaatttaatttccatagcataaaaccgacctatttaagtataaaatccaaatatatttagtatgcttacagtcatgaagccatcaccatcatataattttagaacatttgtatcaacgtaaaagaagccataatggtatagaagtcactttgcatgaccccttagccctaggctaacaccaatttgctttccttctctatagattattctctctacatatttcatataaactgaatcatataatttatgatgtgtaaatgacttcttttaccaagtacagtttttgttgtttttttatggtttttagctttatttatattgtgtgtattaatagttcatttatttttgcagcaatatattttataatatgggtatgccatattttatttgtctctttattagctcattcaccttttgattgtttccagttgtggctattaggagcattgctacatgtttttgcatgaacgtgatttcatttcttttgggtagatactagacgtggaatttctggctcttgtaggaactgtgtgtttatgaaaattgccaaactgttttccaaatgcttgttccatttgtcattaccaccagcagtacaggagggttccagttcatccacattgttgccaacacctgttattatttgtctttttgttataccattcttggtgggtgtaaaaagacctctcattgtagccttggattgcattttgattatggccagagatgttgatgttctttatatgtggttactgaccatgcatatacattctttggaaaaatgtctattttaatctttgaaacattttaaaactttgatatttgtcttattattgagttttatataagaactatttatgtattatggatacaatcccatatgagatatataatttataaatatttcgtctcgttcttggtgcactaacattttacatttttgatgatggtctttgaagcacacaaattttatttttagtgagtaaaatttttgataattgattttttcatactccaaagaaagcaatgcgcaaaatgccttgcccaacccagctactatcaattcagcattcataactactattaataatgtttttatgtaaaaggggcttcacctaaaggaatactttaaaagtactttatcacaaagaaaatagaaggataatgaatgataaagctacctttaaagaatacaggaaataattggaaaagaaacataaaacaggttagacaaatagaaaagaaatataaaataaggtagtagatttaaatgtgaatatacagatacttccattaaatctaaactgacctgaaaaataagaccaaataatgagtaaggacataaaacaattgaagaacacaattaacaattgtaatgttgtaatgtaacataacacacacacacatatataactcatacatatgtattctatatatcaactggaaggcatagttttctagagcatgttgagtaggtaatagttatttgaagttacatggggagggtcataaatcaagattcagtatgtatgaaaagattcaatatcataaagagtataagatccagccatagtgaatgtgagaaattataaaaatgataactaaaaaatctttaaattttgaatattaaatacactttagaatattttaaagtaaaaaagtaaatcataattatgcacacacttttatttcaacaattccactctcaattatataggaaaatatatgtataaatttgtaagcctattgctatatacaagaatgtttatgacagaattattaatagtgtccagaaattgttggcactcaaatgtctattgattataaactaaaaagataatctgtggtattctcaatcaatgaaatactacacagcaacagaattaaaccaacaactgctacattaaaaaaaaaagacactttgggaggctgaggcaggtggatcacgatgtcaggagttcgagacaagcctgacgaacatggtgaaaaccttgtctctgctaaaaatactaaaattagccaagcatggtggtgcgcacctgtaatcccagctactcaggaggctgaggcaggaatattacttgaacctgggaggtggaggttgcagtgagccgagatcatgccactgcactccagactaggtgacagagtgagactccatctcaaaaaaaggaaaaaaaaaggagtatatattacataattaatttaattacataagcaagtaaagctgaagtatgacctttgaagtcaggttaatacttaattggaggacaaaagcagtgactaaaatggtccaggaaaagagagttcttctaagaagattctgataccctctatcatgatctgagagatagtggtatcttcacttcgaaataatgtttaagatgatcttaccttattgggctgtttcacttagcgtatgtacacttatgttatgtgttttatgcttaaatgtgtattttagaagacgtacaatgtattttaagattataggaatcaaataagttcaaaataagcacaaaaagtagaggaaatcctaggggttctatcatagtgtggccaggaaaagcctctcttattggtaacatttagagggttgcctcaaaaagagatagaagcatgccttgagttgttgcaagaaagaatactccaagtgtgggtagaggggacgcaatgtgtaagatgctaggacaggagcttaaagaaaaatataaggccaatgtccctagaagacctagtgtgcatgggaaagtggagaagagcttgccagtgtctgataatgcaggatcctgaggaccaaataacagagttggattttattcttgatatgatgaaaagtcaggcaaaagtcttaatcaggggagtatcacaatctgacttttatttcaaaaataatcattctggctactgcgtgggaaacagtaggacacaaagagtagaatagaagcagagcatgtggctatgaggcatttcacccacatgacacaattcctctttagaaacttaaagatgataattctcaaattgtattttaaggtgtatatcttttaccacttaaaacggctcatgatgctgaccatgattttatacgcctgctggagaactaaaggagtgtaactggatatttcataacacaaagataaatgcttaagcaatgggtagcctttcttcatgatgtgattatttcacactgcagcctgtatcaaaacatctcatgcacctcatagaaaaatacccctactatgtaaccacaaaaactaaaaattaaaagaaaataaaattgctcatatgttctctgcctcaaataattaactttctcacctgaccctccatttttactttaaaaatatttgtcaattatgaaattccaatttaaaagccaaactttctatgatgactcaaattaaaatacacacattctatgtcaattctatgacatttactttgaatgatctggcactttaaaaacctttcgtggacttgatgtgctcaggcaaattaacttaccttctctttttttgagagggaagtctcactctgtcaccaggctggagtgcagtggtgtgattgtggctcactgcaacttccgcctcttgggttcaagcgattctcctgcctcagcctctcaagtagctgggactacaggcacatgccaccacgcctgggtaatctttttttttttttttttttttttttcatatttttactggagacggggtgacggggtttcaccgtgttagccaggatggtcttgatctcctgacctcgtgatccgcccgcctcgacctcggaaagtgctgggattgcaggtgtgagcctccgtgcttggccaaattaacttactttcaatgttgatacttttctgcttatcgtttagatataaagagaatgctatgaaattatcaagaattcatcatgatcaaccagtgaagccccttgaaagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctttgttttttaggtatttcaatagcttttgggtgacaactggtttttggttacatggataagctctttagtggtgatttttcagattttggtgcactcattactcaagaagtatacactgtacccagtgtgtactgttttatccctcacatccctcctacccttccctctgagttccaagagtccattatatcattcttatgcctctatgtcctaatagcttaggtcccccttataagtgagaacatacattgtttggttttatatttctgaattacttcacttagaataatggtctccaactccatccaggtttattttgtccattttgatggctgagtagtgtatatatatatatataatatatgtgtgtgtatatatatatattccccaactagtggctaaagtaaatgtgatatttatatataatatatattagatatatataattatatatgtatgtgtatatatatataattatatatgtatgtgtatacaaacacacacacacacacacacacacacacacacatatatatatatatatatctcacattttctttatccacccattgactgatgggaatctaggctggttccacagttttgcaattgtgaattgtgctgctataaacatgtgtgtatatgggtctttttcatataatgacttattttcctctagatagatgtccagcagtggaattgctggatcaaatggcagttctacttttagttatttaagggatatccatattgtttgccatagtggttgtactagcttgcattcccaccagcagtgtaaatgtgttcccttattactaccatgccaacatctattatttttggatttttaaactatggccattcaccatttgtatatcttcttttgtaaattgtctattcatgtccttaagtcacattttgagggattatttgtttttgtcttgctgatttgtttcagcactctgtagattgtggatattagtcttttgtgggatgtgtagtttgtgaagattttctctaactctgtgagttatctgtttactttgctgattatctctttcgctgttcagaagctgtttagtgtaattgagttccatctatttaactttgttttggttgcctttgcttttgggttcttggtcatgaagtctttgcctaaacaaatgtctagaacagtttttatgatgctatcttctacaatttttatacttccaggtcttagatttaattatttgattcatcttgagttgatctttgtataaggtgagagatgagtatccaatttcattcttctacatgtggcttgccaattatcccagcaccatttgttgaataggttttcctttccccattttatgtttttgtttgctttgtcaaagactagttggctataagtatttagttttatttctgaattctctattctgtttcattggtctacatgcctgtttttataccagtaccatgctgttttgttaactatagccttgtagtatagtttgaagtcaggtaatgtgacacttccagatgtgtgttttttttgttgttgttgtttgtttttttgcttagtcttacttgggctatgtggacatcaaagctgagaatcaaataaaaacctcaacccctattaaagcatctgcaataataataataataataaaataaatacttacaaatatacttaaccaagaaggtgaaagttctccacaaagaagaccaca

SEQ ID NO: 14337 - DNA, 18452 bp, Human
  misc_feature (1)...(18452): n = A,T,C or G
ttccaaaacctctattgtcaatacttaaatcattgtgacattgattgatattgatatgtaccaagttagagaaagttataaagaaagatagcattttaacaagttgtctaagaaatgggcttttttgtttcttatgctgacagttgtattttagccctgaatcctgcgagaatgtgctggtgtggccgatgaaatacagtctttgtatcaatttaatgttgatacttgatgaacttgctcagaacaccatgaggtaactgtgcttgtcaccttcagcttccatcctcattgattccaacaatctgctgttaaatttgaggtttatcccacatcttttactcagaatgaacttgatttcctttttatgaaattgatcaatatatggatgtataagtttccaaagagtacattgttggcatatgattcaaagatgcaaaaactacatatcatgaatgttctgatactgttcaaaagctctttgagtatgctgttttgaacaagaaaattatgaggaacaggattccagaatttatgtcattcttgcagatgtcagttctcagtagtgagctgctatctgaacagcttagtctgttaaacatttgttatacatttggtctactatcatcaatttacaactggcagtatgtaccaagaactctgtggaggacttacattacctccttctgatgtaactgttgtcatatcagaacttagtacaaaaatacatttgtagaaaggtgaaaagtctgttgcattttcttcattttgactttgcatttgagatttttaacaaaaagaagtgggatcagttttacagtgaagtattaggtaagttagtgtttaatttattcacttttccctccaatatatggaaagaaaccttccttttttgtgtctgttggagtgtgtttataaattaaaataaaaaataacctttttggttatgtgaaagacaagggttggcaagattgtggagacattgaaaccttcatacattgttggtgagaatagaaaattattcactcactctgaaaaagtctagcaattcctcaaaaggttacacttacatttacacataattcagtaattgcctttctaggcatatacccaagaaaaataaaaacatgtccacagaaatcatgtacatcaatgttaatcaatgttattcataatggccaaaagtggaagaaaatcaatatccatcaactgataaatgaataaataaattgtatttataaatagcatctgatactatttggcaatagaaacgaagtccttatttacactattctatggatggtcctttaaaaacattaaactaaataatagaaggcagccacaaaagaccacatattatatcgttccatttacttttagaaagatcctgaataggtgtatttctagaggcagaaattagattactggttacccagtgcaggatggatgcagaaattcagtggggagaagagagctaatatacaggaggaattttctttttttttagataaaactcattgttatgttggatgcacaaatctgtgaatttacaaggaaatacttaattttaaataataattgatgaatcatatggtatttgaattatacttcaacaaagttttacaaggtattccttgaactacgatattcaaaaatgctatttgcattgtacaatctctttatctcttatttggtgtcaagggccctgcaggactgtctcacttgccactgttcttgacaccattataaaatacattgtataaaacagggtacttgcaaggtcattaatcttaggtagatgacagcaaatataaaagaaacatcaaacatccttgagtaaatatgaagcaaccgaactttgtttgtctccttgccatccatggactcaggatgttcatataatgtatttactttgaattgaaggagttatgttttaacttgattgatttatctctgtatataagtatgagaaagaaacagtgacttgaaaagaatgatcacattgcaccaggatggttctgaaatgggcttcagttcttctgctgatacatctcagttgttactttagctctgggagttgtggaaaggtgctggtttgggccacagaatacagcctttggatgaatatgaagacaatcctgaaagagcttgttcagagaggtcatgaggtgactgtactggcatcttcagcttccattctttttgatcccaacgactcatccactcttaaactcgaagtttatcctacatctttaactaaaactgaatttgagaatatcgtcatgcaacaggttaagagatggtcagacattccaaaagatacattttggttatatttttcacaagaacaagaaatgctgtaggaattacatgacatatttagaaaattctgtaaagatctcatttcaaataagaaacttatgaaaaaactataagagtcaagatttgacatcgtttttgcagatgctttttttccctgtggtgagctgctggctgcgctacttaacataccctttgtgtacagtctccgctttactcctggctacacagttgaaaggcacagtggaggactgattttccctccttcctacatacctattgttatgtcaaaattaagtgatcaaatgactttcatggagagggtaaaaaatatgatctatgtgatttattttgacttttggttccaaatatgtgatatgaagaagtgggatcagttttacagtgaagttttaggtaagaattttttcagttggtaacataaatatctaacttatttgtgtctttgaagcagagcttatataaagccataaagtcagggaagtggagtttttggtaagtgaatttgtgaaatgaaaatacaagatgatctatcaatctcacaaatattatagaaaatcttaaattatggggtctcttaaaaccctgtggccatctctcacatagaacacgctaggaaatcataaacaaatattagtacacctaagacgttaagcaattacacatctgttttactatataatgttttagatcttaaaaacagtaaaatccatcaagtaacatcttaccaaatgcatagatttagaatgagtaattatacatttttctacaactatctatattactgcagaaatttttctctgtaaatctcagttttcttatttagaaattaaaagatattcccatgttaccagaaggtttccttcacagtagagagagataatgtctacatctcaggtgcaaaaatcaataagggtaatttgaagtttctaatgtttttatactccttcactaaagaattggaattcattcatttgaagtccaattatcttgttgaagtgtgaaggttgttagatctatatagtttatttgaaactatgtctctttatttaaaaatatgagacagattaaggttgagtacagatctctatttcaataatttctcaaaaatatctagctataatttacaaatatatttacttaaaagataatattattaagatcttagctcaaatccaaatgagtagttggtacaaggatttctgccacactctcaaaatagtccagagttcacttgaagaaccaaggataaaaggattagctaaatgagctgtgtaaactagactgttagaaaattgtttttatgggtacagtagaattaattgattatggagctcaaagagttgtttaaatatctatatgctactattgaagctttaaagagaaaataaattgatgtttaattatctatgactcattttaataattgtgagtatactgacatgacattagagatgtagcttaacctcataattctcccaccactttgcctttcttataaataaacatgggcaaaatatataatacataaaaatatattattcatatatatgaatatatgtatatatttttcaaagcacacaaactttacctacatctttgcctacgttattctaacccctttgagaaagttatataaagtaattatcttacgtcatccactttttcttttctttattcctgtcaggaagacccactaccttatttgagacaatggggaaagctgacatatggcttatgcgaaactcctggaattttcagtttcctcatccattcttaccaaacgttgattttgttggaggatttcactgcaaacctgccaaacccctacctaaggtaaacatgctttcgttggttttattttgttggcttcgaagtttcagtagaaatgagtctatagtcttcattcagaatgtttgacttacactgaaagaaagatgggaagtaggtggtgtaaagcagataccaattagaaactcatgtacatgttaataccatcacacatatgtgagttttatgcatattacagagagagaggaatagtaaggagactttgaaaatagagttggttaaagtaaagtcttgattatgcaacacctaagaaggtattgatcattcattcagagaatatttataaagggattagcacaaaacacaagtaagtgcagaaatttcagagaaaaaaaaagacacagtttccgtccctacatactttacattctactttgaaatatagaatataagtaattaatgaaaatgttataaaaaactattatctcaaggaaaaacccaatgtcaagaaagcatcagtggagataatagaaagtatcctggagttactgattagtaagatgagagctgaacaatatgtaggaataggtaaaagaacgacggggaggggcagacaaaaagggaaagcagataaagtggtcaggacagttctcaagtcctcaggttttgttttcagggaatgattaagaatcagatgatattaagaggtaaattagagccagatacatattaggagtggaaatatttgttaagaatattgaaaaactactaaaaagagttaagaaataaatatatatgaaacgattctcttttttaagaaaagcctccaagatattcaatggattaaattacagaagggccacactgtaaagagccaaccattcaggaaattttgcatggattcaggtagcagatgatggaaaagtggactagaatgttgatagaaataattatgcctacatttacaaaaatagtgccaacttcatattgtgttgtgtggaaaaaatattaaaacagacaaaacacttaaaatgtctctggcatatagtcagtgactcagaaatgttattaattttgcaattatggttattttgtgattattactaatactactaactacttaacatgtgcaagtcacttgagatatcattcctcatttaagagaaccagattattcagcacatcaaggttatattctcttgcaaagtcatagatgacagataccctgtggacttgattaaaattagacatatcaattgtgacagcaagttgagctacttgaaattctaaaattctaccataagtaataaggatcttcaccagtattccagcttaaaacccttcctcaacaatataaatgtgtgccttaaatatgtgcagacaaacccagggttcacttgactttaataaagtatttaaatcatttctgcattgagatcccagaattttacattttagatcataaacataccctattagagcagacgatgtctgccttatgacaagcaactcagtaaagcttcctgggggaacttgtctcaacatcataggtgcctgacagagaagcacagagatagtgaacaatgcatgtataataaagaccaaataatttctaccacttgtatctgaatagtgcccttagtttcaatacgaaaaaaattctgtcagcatataagattatattctttttgaaggaacacaaaaaccacatatattttaaattaatatcacattttaagacatacgtacaaagaaagccttcttcaatgcattattatgcaacctcttaaaagaacatgtttgcttacataaaactgagattttattccattgttaaaactcagtatctctgtttaatgcaaattgtatgggctttatatagtcactttctcaagagacaaaagctgaggtaagactaatgaaaaatctatgccactcaacactactcttgaaagatttccccattcacattaagggaaactgacagtgcaaattggaggaggaagagagtaggaggtgtaaaaggacaagaaaaaaggttgactagtagtacaatagtggtaattactaatactaggtcttgttattaacttgcagaaagctttgaatgcaagtcaattgttgtgaaactgcttctttgattgtttattatgtaaaacaattgctaacccaggttgcattcttttcaattatatattacattctcagataatttctatatattttaagagaataagacacttgacaaaatgcatcaagtgttttaaaaatgcatattgttattaattttataatatattcacgtgaaatcataaaaaaatcaaggtgtatctattaaaccttatggaaaatattcacaaaattaacattagaagtaatccaacatcttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggttttcatacttttataaaatttcttacattaattttgtattatttttataatattatcacaaaaggagaaacaagcagtccatatcagtgatgaatctctaaacagaggttagattccttcaacacctggtagaaaaacaaggctctggtatcaagccagtgagatgaaacactgaaaacgagttacattaaatgtggctacaggtaactgcaatcacatacaacacctagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacatgcagacacatacatacatatacacacatatttacacaaatatccttaacagaggccaactatctcaaacatcttcttgcaaagaaactgaatgattcagttaaaaaatattattaattccaataattcctcaaaatacttgattttctctctttaatatttggtaccaattctttcagtagtgcctgctgtggtgatactcttttgtgatgaaacaatttttttttttcacaggaaatggaggagtttgtacagagctctggagaaaatggtgttgtggtgttttctctggggtcaatggtcagtaacatgacagcagaaagggccaacgtaattgcaacagcccttgccaagatcccacaaaaggtaagataaagtgccttactggtgtggaaaactactgaaagaggctgttaaagtttgtgatctacatagaaagaatattaagagtagattgaactctttacagccaaatgcagccttaaatatgcttgtgtagcttccactgacacaagtaatagttgtgcctcagacttagtggttacatgtggccctggggtagttactgcccttgttatgcatgagtggttcctattagtatcagtgggaactcagtactccatatgtatccacaaaagggacattgagactcatggttatttttaatttctaatattaacagtcatacatactgctgaatttaactcaatatagttcaggtaagtgaaaatggtgcttaatgtaatctttagaatgactttcaggtgttttcaactaaaaatacatatccagaactgcatctttgtagaaatacaaggaagacttatgataattttcttcaaaacaattttcctaatctcagcaatatccaatgagtgaagaacatttgacttactcttgggccacctctactacttaccgtactctggaagctcttggtgaatgtttacaattaaggaatgtactatttctgtttgtactttaagtcaaatgcttatgtgaaatatgtgacaacaaatagagaacactgcctgaagcaggaagatgaaagagaaaggatggagatggatcctgacctgaaggtggatcctgtccagtataaaatgtggccccacaaggactcaacactaactaccagattaacaacccctcccaatggaggcagcggaaggaaatataggaaggagtcaaacagaaggaagccaggcagttgaacaggttcagatgccccctccatagaacacagtaggaatatattttcttctatatagaataaacaagggacctttgtgtatttgtgaattactttttaatttcctatctgataaagctttcttgtaatgacctctaactttttgctgaaacctgagttactttaacactgatgtagcaaataaaagttaaaccctgtaaattattgttcagtttgtgaggattgctttggagtttcaaaattagtaacttaaacataaaaatgtcttggctatagcagaacatattaatcactgttgtcaaagtttgtagctcgttgtctaagtgttaataatcagttgaccaaattcagcaaaatacaattttgagtttattcaacagctttatttgtattcatgataccaacaggttcctcatttctaggcaaaaaaaaaaaaaaaaaaaaaaaaaaattaacaatacggtaatattctgaatttgtgtctaaaattgtcacttgaaatttttcttggaagtagtgcttgataatttgtaattccaatgaagttatacataacaccttggcagcatttatttatttattataagtagcttattttacagacttgctattttgtcaatcaaaggacaacaggctctaatgtaataacctaccgacaagtagatatatttaaactacttctcatattattcaaaaataaatgaatacattacaattaaatttggagatgaagactaatataaaatacataaaacaaacatataggtcattactaaatagttactgtttttttacactggaattacaatgactccttataagtttttatactttttttagaatatttttattttttaaattaaattaatttaacttttatttttaacgtttattttaagttcaggagtacacgtgcaggtttcttacatacgtaaacttgtgtcatgggggtttgctgtactgattgtttcattacccaggtattaaaactaatatttgtttattagttttcctgatcctctctttcctcccaccctccaccctccaatacatctcagtgtatgttgttgccatgtatgtgtccacatgttctcatcttttagtttccactcataagtgaggacatgtcacatttggatttcaattcctatgttagcttgctaaggctaatggcctcctgctccatccttatccctgcaaaaatacatatttttgcttttttatggctgcataatattctgtagtgtatatatgccatattttctttattcattccataattgatggtcatttaggtttattgcatgtccttgctattgtgaatagtactgcaactaacatatatgttcatggatctttataaaagaacaagttatagtccttaggttatatacccagtaatgggattgctgggtttcatggtatttttgcctctgggtttttgaggaatcaccacactgtcttccacaatggttgaactaacttacattccaaccaaaagagtataagcattcctttcctatataacctcaccaacatcatgatattttttgaatttttaataatggccattctgactggtgtgagatgctatctcattatggttttgatttgaatttctctaatgatctgtgatgttaattttttttcttcatgtgatggttggccgcaggtaggtctttttttaaaaagtgtaacaattttttaaatacttgaacttttcattgataatcttatttttctaaggtactattttggaaaatcatggtttcttatatatctaaatcattataaaagttaagaaaataaaatgtgagtattgtttttacatcagtctttgagtagatttatttactaacatcccttgatctcattcctaccctttttacagttctaacattctataatttttgagttccactcatggaataagatattctctttactgtaacaggttctgtggagatttgatgggaataaaccagatgctttaggtctcaatactcggctgtacaagtggataccccagaatgaccttctaggtaacactctggtgaacaaatactggatatattagtaactgcacattagaatgttaatagttcatcttgaaacatgcttattgaatatttgttataggaaaacaaaaagaacttctttatatttattttccagtcctaggggaaaagaatatgctataattgttggcattttatgatatacactcacattctttatggtcagaatcagagagaatctttatttcaggtgttattatatctcacagaatttttcagtatcttcctgggctgtctctctgtctcctatttctacaactttacacctgttttctcctctcctgcagggttatttcaaatgccactaaatataatagctcttctatcaccagtgactctgtattttccggaggactaaattcctaatcttaatcttaaagtaatgacacatttcatgatgaagtgtaacctgtctttcctcaatcctagcaccaccaacaacccactgcctgctgccttgcataccccgcatatcacactctgtgactgtacttaaaataaaactttatttcatgcccatctctttgctgtcctcttttgtgcacatttaaaaaatctagaatgcacttttcattagtgcaactgaaaatcttgtattaagttttgcagtctgaagtgacacacaccatatagctttcagttacatctcctaaacaagtacgtgctttttcatctgaagtctgaaaagtaatagcaaattagttcaatgtgttatctagaaaacactgtcactttcagagcctttcattgtgcatctcattttattcctatgaataattttgctaaaattcatccaatcctaggtcatccaaaaaccagagcttttataactcatggtggagcaagtggcatctatgaggcaatctaccatgggatccctatggtgggcattccattgttttgggatcaacctgataacattgctcacatgaaggccaagggagcagctgttagactggacttccacacaatgtcgagtacagacctgctgaatgcactgaagacagtaattaatgatcctttgtgagtagaacaatgtttttcactaggtggtatttgtagacagcttctcttgtcaatagtgagcatgagtttcatcctttttatgagagtaattttgaaagaatttaaataatttaaccaatctgaaatctgctttttttcatctgttatttaaaaattgtatttgaaccccatacatctaatgagtaaccagttagtgaaacaattttctaaacaaaaataattttaaaatgtatagataatataaaaaatacatttcttaaaattttaacataatgaatccatagtagaaaggaagaataaacttgaaataatataataaaatgttttaattaaatatctaaaatgactcagaatataactattttcttgctgaaaaattaatttttatcatcattattttaacagacttgaaaatgagatttaatttcgatagcttaaaatccacctatttatgccataaaatccaaatatttttactatgtttacagagtcatgaaactatcatcattatataattttagaacatttttatcaacacagaagaaacttcaatgacaccaaaatcaattctcatgactgcttagtcctagtctaacaccaatttgttttctttctatataggttattctctctagatatttcatataaatggaattatacagtcttgggtgctgtgtaaatgacatttcacttagcctaactttttgtgttgttttatggtttttattttaattcatatggttgtgtgttttaatacttcatttccttttcacttctataatattttatagtatggatatgtcataatttagttgttcatttgtcagtgcattggccttttgattgtttccaattgtggctactaggaatattgctatacatgtttttgcataaacatgttttactttcttttgggttgatgctataagtggaattgctgcctcatgtgagaactgtatgtttctgaagaactgctaaactcttttccaaagtacttgttccgttcatcaataccgtcagcagtataacatggttccaattcctccacactgttgccaaaccttttattttctgtctttttgttacagccttcttagtgggtgtaatgatctctcatcctggtcttggattgcattttcattactgctgaagatgttgagaatctttaagtgtgcttattgatcattcacatatcttcttagaaaacatgtctactccaatgcttggaacatttttacctttgttatttgtcttattattaagttttaagaactatttatatattatgggacaaatcagatatataatttttaaatatttttcccattctgggtgcactaactttttactttttgatggtctttgaagcacaaaaaatataattttaagtcatatttttaataattgattttgttcacaccccaaagataacaatgtgaacaattccttgcggagtccagctaccatcaattcagcatttataactactctcaataaagtttttgtgtaaggagggtatcatctaatggaatactttaagaatactttatcccaaagaaaatagaaggataatgaatgatcaatatacctttaaagaagatgggaaataattgaaaggcaacacaaaccagcttggacaaatagaaaagaaatataaaacaaagtggtagatttaaatgtgattatacaaatactttcactcaatctaaacagacttttaataaaagagcaaataatgagtaaggacataaaacatttgaagaacacaattaacaaatggaatcttataaagtaaaatgatatacacacacatatatacataaacaatatacatgtatgtattgtatatatcaacttgaagacactttttcctagagtacgtcaagtagttaatctttacttgaagtgatatgtggtgggcaataaatcaagacttaggaagtataaaaagattcaatattatgaagactatataatccagccatagtggaaataaaggaggttaaaaatactattactaaaatatctttaaattttggaaattaacaaaatacacttcaaaaaagtttaaagtcaagaagtaaatcataagtattcatgcacttttatcacagcaattctgctctcaattatatacccaacagatatacataaatatataaatctaatgctgtatagaagagtgttcatgacagaattatcaacagtgtccaaaaattgttagcaacccaaatatctattcatcataaaataaagacgtaatctgtggtttatcagtcaacagaatactacatagcaatggaattacccaagaactgctacagtaaagaaaaagacactaatgagtacatattatataattcaattacacaaacaagcaaaactaatgttgttattcgaagtcaggctaatccttagttgtgtccttagttggaggacaaaagtagtcactaaatggttcagaaacagaaagttattctgggcaggttttgatagcctataccgtgacctgaacagtagttaaattggtatcttcaccccaagataatgttcaagatgatcttccatttttgaactattcacttagtgtatgtatatttatcttttgtgttttatatttaaatgtatattttatgagatatataaatcatttacaaaattctaggaatcagatagaaaataagcacagaaaatagagaaaatcctagaggctccatcatagtctggccagtaaaagcctctcttagaggtaacacttagagggtagccacaaaaagggagagaagcatgccttgggttgtagcaacaaagaatactccaaaagcaggagagaagggacaaaatgtgtaaagtgctaagatgagaacacctttggaagcttaaagaaaattagaaggccaatctagaagacaatgtgcaggggaaaagtgttagaataagagcttgccagtgtcttacaatgtagggttctgtagatcaaataacagagttgaattttatgattaaaagaatgagaagccaggcaaaaatcttaatcagaagagtgccataatctgacattaatttctaaaaatcattctggctacagggtgggaaacagaaggagacaaaagagtaatgtagaagcaaagtgacaagctatgaggtatgtcactcgccatgataaaattcctttttaggaacttacagatgataattctcacatcgcattttcacaatctttcttacagcacttaaaatggctcatgatgttgagcatgtactcatatgcctgtttgagaactaagagtgtaattggattgttcataatacaaaggataaatgcttaaaggatgaatatcctatttttcatgatgtgattatttcacattgtatcaaaacatctcatgtaccctataaatatatacacttaatatggacccacaaaaacttaacattaaacaattaaaaaccaattaaaatgccttatattttctctgcttgaaaaaaattaactttctcacctgagcttccatttctactttaaaaatatttgtcaattagaaaagtccaatttaaaagccaaactttctatgatgactcaaattaagatacacaaattctctgtcatttctttgacatttactttgaattattggacgctttaaaagcctttcatagacttgatatgtacaggcaaattaacttactttcagtgttggtatctttatttttatccttcagatataaagagaatattatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgacatttatcatcacaaagtgttgtctgttttgtttctggaagtttactagaaaagtgaagaaggaaaaaagggattagttatgtccgacatttgaagctggaaaacctgatagatgggatgacttcagtttattccagcaagaaagattgtgatgcaagatttctttcttcctatgacaaaaaaaaatctttttgaaatctaccttgtcaagtgaaaatttgtttttcagagatttaccacccaagtaatggttagaaatattttgtggcaatgaggaaaacactagggaaaataaaaaataatataaagccatatgagcttatattgaaatttgttgcacttatattgagatttgttgttttaattcgcaagttacatgaaaaaaaattactcagcttaactatatttcacacattttacataaacacaagaacattaagaagtctactgacagtatcagtactgttttgcacatactcagaataatttggcttcattttgcacaggattctgttgttttaactgttgctaaagaaactattacatagttaaattgtatagaaagtttctctctgccttttgatattttgagataagtagtattgcttcacttttacactccatgcagctttattgtctaattttttgctaaaattgatggccaaatgtttactgttttaagaacttaagtcatttctcagtggaaattatgtggaattagaaatatagccactgttacctgcttcctactgtaaaatttaactattttgccacatctttggtttcatgagcaaattctattttttccagatatttaaacatatttgtctggttgattttattctcatagttttaattacttcaatagttatttgggaacaggttgtgtttgattagatggataagttttttagtggtaatttctgaggttttggtgcacatatcatgtgagaagtgtaccttgcactgaatgtatagtctagtatcccttgcccccctcccaccctcccatctgaatccttagagcccattatatcattcttatgcctttgcatcctaatagcttagatcccacttataagtgacaactgatgatgttgagttttctattcctgaattacttcacttagaataatgctctgccacttcatgcaagttgctgttaatgccattagtttgtttctttttacagcttagtagtattccatggtatatatgtatatatagtatctatatgcatgtgtgtgtatatgtgtatgtgtgtgtgtgtgtgtgtgtgtgtgtgtgtgtgtgtgtgtgtgtgtatcaggggaacccaccctcaatatttcaatggagtttctttctattttccataagtgttggctggctgagaaataaagataaagagtacaaagagaggaattttacagttgggccaccggggttgacatcacatattggtaggactgtgatgtccacccgagcctcaaaccagcaagttttttattaagggtttcaaaaggcaggggtgggggggtgtaagaacagggagtaggtacaaagatcacatgcttcaaagggcaaaaggcagaacaaagatcacatgcttctcagggaacatggcaaagagcaaagcagagctactgataagggtccaaaaaagatcacaaggcaaagggcaaaagcagaactactgataagggtctatgttcagcagtgcacgtattgtctttataaacatcttaaacaacagaaaacagggttcgagagcagagaactggtctgaccacaaatttaccagggtgaagtttttccccaccgtaataagccggagggtactgccggagaccagggcatatctcagcccttatctcaaccgcataagacagacattcccagagtggccgtttatagacctccccccaggaatgcattcctttcccagagtactaatataaatattccttcctaggaaaagaatttggtgatatcttccctacttacacggccatttataggctctctgaaagaagaaaaatatggctctttttgcccgaccccacaggcagtcagaccttatggttgtcctcccttctcccctaaaaattgctgttattctgttctttttcaaggtgcgctgatttcatattgttcaaacacaagttttacaagcaatttgtacagttaacgcaattatcacagtg

SEQ ID NO: 14338 - DNA, 18373 bp, Human
  misc_feature (1)...(18373): n = A,T,C or G
tttccaaaacctctattgtcaatacttaaatcattgtgacattgattgatattgatatgtaccaagttagagaaagttataaagaaagatagcattttaacaagttgtctaagaaatgggcttttttgtttcttatgctgacagttgtattttagccctgaatcctgcgagaatgtgctggtgtggccgatgaaatacagtctttgtatcaatttaatgttgatacttgatgaacttgctcagaacaccatgaggtaactgtgcttgtcaccttcagcttccatcctcattgattccaacaatctgctgttaaatttgaggtttatcccacatcttttactcagaatgaacttgatttcctttttatgaaattgatcaatatatggatgtataagtttccaaagagtacattgttggcatatgattcaaagatgcaaaaactacatatcatgaatgttctgatactgttcaaaagctctttgagtatgctgttttgaacaagaaaattatgaggaacaggattccagaatttatgtcattcttgcagatgtcagttctcagtagtgagctgctatctgaacagcttagtctgttaaacatttgttatacatttggtctactatcatcaatttacaactggcagtatgtaccaagaactctgtggaggacttacattacctccttctgatgtaactgttgtcatatcagaacttagtacaaaaatacatttgtagaaaggtgaaaagtctgttgcattttcttcattttgactttgcatttgagatttttaacaaaaagaagtgggatcagttttacagtgaagtattaggtaagttagtgtttaatttattcacttttccctccaatatatggaaagaaaccttccttttttgtgtctgttggagtgtgtttataaattaaaataaaaaataacctttttggttatgtgaaagacaagggttggcaagattgtggagacattgaaaccttcatacattgttggtgagaatagaaaattattcactcactctgaaaaagtctagcaattcctcaaaaggttacacttacatttacacataattcagtaattgcctttctaggcatatacccaagaaaaataaaaacatgtccacagaaatcatgtacatcaatgttaatcaatgttattcataatggccaaaagtggaagaaaatcaatatccatcaactgataaatgaataaataaattgtatttataaatagcatctgatactatttggcaatagaaacgaagtccttatttacactattctatggatggtcctttaaaaacattaaactaaataatagaaggcagccacaaaagaccacatattatatcgttccatttacttttagaaagatcctgaataggtgtatttctagaggcagaaattagattactggttacccagtgcaggatggatgcagaaattcagtggggagaagagagctaatatacaggaggaattttctttttttttagataaaactcattgttatgttggatgcacaaatctgtgaatttacaaggaaatacttaattttaaataataattgatgaatcatatggtatttgaattatacttcaacaaagttttacaaggtattccttgaactacgatattcaaaaatgctatttgcattgtacaatctctttatctcttatttggtgtcaagggccctgcaggactgtctcacttgccactgttcttgacaccattataaaatacattgtataaaacagggtacttgcaaggtcattaatcttaggtagatgacagcaaatataaaagaaacatcaaacatccttgagtaaatatgaagcaaccgaactttgtttgtctccttgccatccatggactcaggatgttcatataatgtatttactttgaattgaaggagttatgttttaacttgattgatttatctctgtatataagtatgagaaagaaacagtgacttgaaaagaatgatcacattgcaccaggatggttctgaaatgggcttcagttcttctgctgatacatctcagttgttactttagctctgggagttgtggaaaggtgctggtttgggccacagaatacagcctttggatgaatatgaagacaatcctgaaagagcttgttcagagaggtcatgaggtgactgtactggcatcttcagcttccattctttttgatcccaacgactcatccactcttaaactcgaagtttatcctacatctttaactaaaactgaatttgagaatatcgtcatgcaacaggttaagagatggtcagacattccaaaagatacattttggttatatttttcacaagaacaagaaatgctgtaggaattacatgacatatttagaaaattctgtaaagatctcatttcaaataagaaacttatgaaaaaactataagagtcaagatttgacatcgtttttgcagatgctttttttccctgtggtgagctgctggctgcgctacttaacataccctttgtgtacagtctccgctttactcctggctacacagttgaaaggcacagtggaggactgattttccctccttcctacatacctattgttatgtcaaaattaagtgatcaaatgactttcatggagagggtaaaaaatatgatctatgtgatttattttgacttttggttccaaatatgtgatatgaagaagtgggatcagttttacagtgaagttttaggtaagaattttttcagttggtaacataaatatctaacttatttgtgtctttgaagcagagcttatataaagccataaagtcagggaagtggagtttttggtaagtgaatttgtgaaatgaaaatacaagatgatctatcaatctcacaaatattatagaaaatcttaaattatggggtctcttaaaaccctgtggccatctctcacatagaacacgctaggaaatcataaacaaatattagtacacctaagacgttaagcaattacacatctgttttactatataatgttttagatcttaaaaacagtaaaatccatcaagtaacatcttaccaaatgcatagatttagaatgagtaattatacatttttctacaactatctatattactgcagaaatttttctctgtaaatctcagttttcttatttagaaattaaaagatattcccatgttaccagaaggtttccttcacagtagagagagataatgtctacatctcaggtgcaaaaatcaataagggtaatttgaagtttctaatgtttttatactccttcactaaagaattggaattcattcatttgaagtccaattatcttgttgaagtgtgaaggttgttagatctatatagtttatttgaaactatgtctctttatttaaaaatatgagacagattaaggttgagtacagatctctatttcaataatttctcaaaaatatctagctataatttacaaatatatttacttaaaagataatattattaagatcttagctcaaatccaaatgagtagttggtacaaggatttctgccacactctcaaaatagtccagagttcacttgaagaaccaaggataaaaggattagctaaatgagctgtgtaaactagactgttagaaaattgtttttatgggtacagtagaattaattgattatggagctcaaagagttgtttaaatatctatatgctactattgaagctttaaagagaaaataaattgatgtttaattatctatgactcattttaataattgtgagtatactgacatgacattagagatgtagcttaacctcataattctcccaccactttgcctttcttataaataaacatgggcaaaatatataatacataaaaatatattattcatatatatgaatatatgtatatatttttcaaagcacacaaactttacctacatctttgcctacgttattctaacccctttgagaaagttatataaagtaattatcttacgtcatccactttttcttttctttattcctgtcaggaagacccactaccttatttgagacaatggggaaagctgacatatggcttatgcgaaactcctggaattttcagtttcctcatccattcttaccaaacgttgattttgttggaggatttcactgcaaacctgccaaacccctacctaaggtaaacatgctttcgttggttttattttgttggcttcgaagtttcagtagaaatgagtctatagtcttcattcagaatgtttgacttacactgaaagaaagatgggaagtaggtggtgtaaagcagataccaattagaaactcatgtacatgttaataccatcacacatatgtgagttttatgcatattacagagagagaggaatagtaaggagactttgaaaatagagttggttaaagtaaagtcttgattatgcaacacctaagaaggtattgatcattcattcagagaatatttataaagggattagcacaaaacacaagtaagtgcagaaatttcagagaaaaaaaaagacacagtttccgtccctacatactttacattctactttgaaatatagaatataagtaattaatgaaaatgttataaaaaactattatctcaaggaaaaacccaatgtcaagaaagcatcagtggagataatagaaagtatcctggagttactgattagtaagatgagagctgaacaatatgtaggaataggtaaaagaacgacggggaggggcagacaaaaagggaaagcagataaagtggtcaggacagttctcaagtcctcaggttttgttttcagggaatgattaagaatcagatgatattaagaggtaaattagagccagatacatattaggagtggaaatatttgttaagaatattgaaaaactactaaaaagagttaagaaataaatatatatgaaacgattctcttttttaagaaaagcctccaagatattcaatggattaaattacagaagggccacactgtaaagagccaaccattcaggaaattttgcatggattcaggtagcagatgatggaaaagtggactagaatgttgatagaaataattatgcctacatttacaaaaatagtgccaacttcatattgtgttgtgtggaaaaaatattaaaacagacaaaacacttaaaatgtctctggcatatagtcagtgactcagaaatgttattaattttgcaattatggttattttgtgattattactaatactactaactacttaacatgtgcaagtcacttgagatatcattcctcatttaagagaaccagattattcagcacatcaaggttatattctcttgcaaagtcatagatgacagataccctgtggacttgattaaaattagacatatcaattgtgacagcaagttgagctacttgaaattctaaaattctaccataagtaataaggatcttcaccagtattccagcttaaaacccttcctcaacaatataaatgtgtgccttaaatatgtgcagacaaacccagggttcacttgactttaataaagtatttaaatcatttctgcattgagatcccagaattttacattttagatcataaacataccctattagagcagacgatgtctgccttatgacaagcaactcagtaaagcttcctgggggaacttgtctcaacatcataggtgcctgacagagaagcacagagatagtgaacaatgcatgtataataaagaccaaataatttctaccacttgtatctgaatagtgcccttagtttcaatacgaaaaaaattctgtcagcatataagattatattctttttgaaggaacacaaaaaccacatatattttaaattaatatcacattttaagacatacgtacaaagaaagccttcttcaatgcattattatgcaacctcttaaaagaacatgtttgcttacataaaactgagattttattccattgttaaaactcagtatctctgtttaatgcaaattgtatgggctttatatagtcactttctcaagagacaaaagctgaggtaagactaatgaaaaatctatgccactcaacactactcttgaaagatttccccattcacattaagggaaactgacagtgcaaattggaggaggaagagagtaggaggtgtaaaaggacaagaaaaaaggttgactagtagtacaatagtggtaattactaatactaggtcttgttattaacttgcagaaagctttgaatgcaagtcaattgttgtgaaactgcttctttgattgtttattatgtaaaacaattgctaacccaggttgcattcttttcaattatatattacattctcagataatttctatatattttaagagaataagacacttgacaaaatgcatcaagtgttttaaaaatgcatattgttattaattttataatatattcacgtgaaatcataaaaaaatcaaggtgtatctattaaaccttatggaaaatattcacaaaattaacattagaagtaatccaacatcttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggttttcatacttttataaaatttcttacattaattttgtattatttttataatattatcacaaaaggagaaacaagcagtccatatcagtgatgaatctctaaacagaggttagattccttcaacacctggtagaaaaacaaggctctggtatcaagccagtgagatgaaacactgaaaacgagttacattaaatgtggctacaggtaactgcaatcacatacaacacctagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacatgcagacacatacatacatatacacacatatttacacaaatatccttaacagaggccaactatctcaaacatcttcttgcaaagaaactgaatgattcagttaaaaaatattattaattccaataattcctcaaaatacttgattttctctctttaatatttggtaccaattctttcagtagtgcctgctgtggtgatactcttttgtgatgaaacaatttttttttttcacaggaaatggaggagtttgtacagagctctggagaaaatggtgttgtggtgttttctctggggtcaatggtcagtaacatgacagcagaaagggccaacgtaattgcaacagcccttgccaagatcccacaaaaggtaagataaagtgccttactggtgtggaaaactactgaaagaggctgttaaagtttgtgatctacatagaaagaatattaagagtagattgaactctttacagccaaatgcagccttaaatatgcttgtgtagcttccactgacacaagtaatagttgtgcctcagacttagtggttacatgtggccctggggtagttactgcccttgttatgcatgagtggttcctattagtatcagtgggaactcagtactccatatgtatccacaaaagggacattgagactcatggttatttttaatttctaatattaacagtcatacatactgctgaatttaactcaatatagttcaggtaagtgaaaatggtgcttaatgtaatctttagaatgactttcaggtgttttcaactaaaaatacatatccagaactgcatctttgtagaaatacaaggaagacttatgataattttcttcaaaacaattttcctaatctcagcaatatccaatgagtgaagaacatttgacttactcttgggccacctctactacttaccgtactctggaagctcttggtgaatgtttacaattaaggaatgtactatttctgtttgtactttaagtcaaatgcttatgtgaaatatgtgacaacaaatagagaacactgcctgaagcaggaagatgaaagagaaaggatggagatggatcctgacctgaaggtggatcctgtccagtataaaatgtggccccacaaggactcaacactaactaccagattaacaacccctcccaatggaggcagcggaaggaaatataggaaggagtcaaacagaaggaagccaggcagttgaacaggttcagatgccccctccatagaacacagtaggaatatattttcttctatatagaataaacaagggacctttgtgtatttgtgaattactttttaatttcctatctgataaagctttcttgtaatgacctctaactttttgctgaaacctgagttactttaacactgatgtagcaaataaaagttaaaccctgtaaattattgttcagtttgtgaggattgctttggagtttcaaaattagtaacttaaacataaaaatgtcttggctatagcagaacatattaatcactgttgtcaaagtttgtagctcgttgtctaagtgttaataatcagttgaccaaattcagcaaaatacaattttgagtttattcaacagctttatttgtattcatgataccaacaggttcctcatttctaggcaaaaaaaaaaaaaaaaaaaaaaaaaaattaacaatacggtaatattctgaatttgtgtctaaaattgtcacttgaaatttttcttggaagtagtgcttgataatttgtaattccaatgaagttatacataacaccttggcagcatttatttatttattataagtagcttattttacagacttgctattttgtcaatcaaaggacaacaggctctaatgtaataacctaccgacaagtagatatatttaaactacttctcatattattcaaaaataaatgaatacattacaattaaatttggagatgaagactaatataaaatacataaaacaaacatataggtcattactaaatagttactgtttttttacactggaattacaatgactccttataagtttttatactttttttagaatatttttattttttaaattaaattaatttaacttttatttttaacgtttattttaagttcaggagtacacgtgcaggtttcttacatacgtaaacttgtgtcatgggggtttgctgtactgattgtttcattacccaggtattaaaactaatatttgtttattagttttcctgatcctctctttcctcccaccctccaccctccaatacatctcagtgtatgttgttgccatgtatgtgtccacatgttctcatcttttagtttccactcataagtgaggacatgtcacatttggatttcaattcctatgttagcttgctaaggctaatggcctcctgctccatccttatccctgcaaaaatacatatttttgcttttttatggctgcataatattctgtagtgtatatatgccatattttctttattcattccataattgatggtcatttaggtttattgcatgtccttgctattgtgaatagtactgcaactaacatatatgttcatggatctttataaaagaacaagttatagtccttaggttatatacccagtaatgggattgctgggtttcatggtatttttgcctctgggtttttgaggaatcaccacactgtcttccacaatggttgaactaacttacattccaaccaaaagagtataagcattcctttcctatataacctcaccaacatcatgatattttttgaatttttaataatggccattctgactggtgtgagatgctatctcattatggttttgatttgaatttctctaatgatctgtgatgttaattttttttcttcatgtgatggttggccgcaggtaggtctttttttaaaaagtgtaacaattttttaaatacttgaacttttcattgataatcttatttttctaaggtactattttggaaaatcatggtttcttatatatctaaatcattataaaagttaagaaaataaaatgtgagtattgtttttacatcagtctttgagtagatttatttactaacatcccttgatctcattcctaccctttttacagttctaacattctataatttttgagttccactcatggaataagatattctctttactgtaacaggttctgtggagatttgatgggaataaaccagatgctttaggtctcaatactcggctgtacaagtggataccccagaatgaccttctaggtaacactctggtgaacaaatactggatatattagtaactgcacattagaatgttaatagttcatcttgaaacatgcttattgaatatttgttataggaaaacaaaaagaacttctttatatttattttccagtcctaggggaaaagaatatgctataattgttggcattttatgatatacactcacattctttatggtcagaatcagagagaatctttatttcaggtgttattatatctcacagaatttttcagtatcttcctgggctgtctctctgtctcctatttctacaactttacacctgttttctcctctcctgcagggttatttcaaatgccactaaatataatagctcttctatcaccagtgactctgtattttccggaggactaaattcctaatcttaatcttaaagtaatgacacatttcatgatgaagtgtaacctgtctttcctcaatcctagcaccaccaacaacccactgcctgctgccttgcataccccgcatatcacactctgtgactgtacttaaaataaaactttatttcatgcccatctctttgctgtcctcttttgtgcacatttaaaaaatctagaatgcacttttcattagtgcaactgaaaatcttgtattaagttttgcagtctgaagtgacacacaccatatagctttcagttacatctcctaaacaagtacgtgctttttcatctgaagtctgaaaagtaatagcaaattagttcaatgtgttatctagaaaacactgtcactttcagagcctttcattgtgcatctcattttattcctatgaataattttgctaaaattcatccaatcctaggtcatccaaaaaccagagcttttataactcatggtggagcaagtggcatctatgaggcaatctaccatgggatccctatggtgggcattccattgttttgggatcaacctgataacattgctcacatgaaggccaagggagcagctgttagactggacttccacacaatgtcgagtacagacctgctgaatgcactgaagacagtaattaatgatcctttgtgagtagaacaatgtttttcactaggtggtatttgtagacagcttctcttgtcaatagtgagcatgagtttcatcctttttatgagagtaattttgaaagaatttaaataatttaaccaatctgaaatctgctttttttcatctgttatttaaaaattgtatttgaaccccatacatctaatgagtaaccagttagtgaaacaattttctaaacaaaaataattttaaaatgtatagataatataaaaaatacatttcttaaaattttaacataatgaatccatagtagaaaggaagaataaacttgaaataatataataaaatgttttaattaaatatctaaaatgactcagaatataactattttcttgctgaaaaattaatttttatcatcattattttaacagacttgaaaatgagatttaatttcgatagcttaaaatccacctatttatgccataaaatccaaatatttttactatgtttacagagtcatgaaactatcatcattatataattttagaacatttttatcaacacagaagaaacttcaatgacaccaaaatcaattctcatgactgcttagtcctagtctaacaccaatttgttttctttctatataggttattctctctagatatttcatataaatggaattatacagtcttgggtgctgtgtaaatgacatttcacttagcctaactttttgtgttgttttatggtttttattttaattcatatggttgtgtgttttaatacttcatttccttttcacttctataatattttatagtatggatatgtcataatttagttgttcatttgtcagtgcattggccttttgattgtttccaattgtggctactaggaatattgctatacatgtttttgcataaacatgttttactttcttttgggttgatgctataagtggaattgctgcctcatgtgagaactgtatgtttctgaagaactgctaaactcttttccaaagtacttgttccgttcatcaataccgtcagcagtataacatggttccaattcctccacactgttgccaaaccttttattttctgtctttttgttacagccttcttagtgggtgtaatgatctctcatcctggtcttggattgcattttcattactgctgaagatgttgagaatctttaagtgtgcttattgatcattcacatatcttcttagaaaacatgtctactccaatgcttggaacatttttacctttgttatttgtcttattattaagttttaagaactatttatatattatgggacaaatcagatatataatttttaaatatttttcccattctgggtgcactaactttttactttttgatggtctttgaagcacaaaaaatataattttaagtcatatttttaataattgattttgttcacaccccaaagataacaatgtgaacaattccttgcggagtccagctaccatcaattcagcatttataactactctcaataaagtttttgtgtaaggagggtatcatctaatggaatactttaagaatactttatcccaaagaaaatagaaggataatgaatgatcaatatacctttaaagaagatgggaaataattgaaaggcaacacaaaccagcttggacaaatagaaaagaaatataaaacaaagtggtagatttaaatgtgattatacaaatactttcactcaatctaaacagacttttaataaaagagcaaataatgagtaaggacataaaacatttgaagaacacaattaacaaatggaatcttataaagtaaaatgatatacacacacatatatacataaacaatatacatgtatgtattgtatatatcaacttgaagacactttttcctagagtacgtcaagtagttaatctttacttgaagtgatatgtggtgggcaataaatcaagacttaggaagtataaaaagattcaatattatgaagactatataatccagccatagtggaaataaaggaggttaaaaatactattactaaaatatctttaaattttggaaattaacaaaatacacttcaaaaaagtttaaagtcaagaagtaaatcataagtattcatgcacttttatcacagcaattctgctctcaattatatacccaacagatatacataaatatataaatctaatgctgtatagaagagtgttcatgacagaattatcaacagtgtccaaaaattgttagcaacccaaatatctattcatcataaaataaagacgtaatctgtggtttatcagtcaacagaatactacatagcaatggaattacccaagaactgctacagtaaagaaaaagacactaatgagtacatattatataattcaattacacaaacaagcaaaactaatgttgttattcgaagtcaggctaatccttagttgtgtccttagttggaggacaaaagtagtcactaaatggttcagaaacagaaagttattctgggcaggttttgatagcctataccgtgacctgaacagtagttaaattggtatcttcaccccaagataatgttcaagatgatcttccatttttgaactattcacttagtgtatgtatatttatcttttgtgttttatatttaaatgtatattttatgagatatataaatcatttacaaaattctaggaatcagatagaaaataagcacagaaaatagagaaaatcctagaggctccatcatagtctggccagtaaaagcctctcttagaggtaacacttagagggtagccacaaaaagggagagaagcatgccttgggttgtagcaacaaagaatactccaaaagcaggagagaagggacaaaatgtgtaaagtgctaagatgagaacacctttggaagcttaaagaaaattagaaggccaatctagaagacaatgtgcaggggaaaagtgttagaataagagcttgccagtgtcttacaatgtagggttctgtagatcaaataacagagttgaattttatgattaaaagaatgagaagccaggcaaaaatcttaatcagaagagtgccataatctgacattaatttctaaaaatcattctggctacagggtgggaaacagaaggagacaaaagagtaatgtagaagcaaagtgacaagctatgaggtatgtcactcgccatgataaaattcctttttaggaacttacagatgataattctcacatcgcattttcacaatctttcttacagcacttaaaatggctcatgatgttgagcatgtactcatatgcctgtttgagaactaagagtgtaattggattgttcataatacaaaggataaatgcttaaaggatgaatatcctatttttcatgatgtgattatttcacattgtatcaaaacatctcatgtaccctataaatatatacacttaatatggacccacaaaaacttaacattaaacaattaaaaaccaattaaaatgccttatattttctctgcttgaaaaaaattaactttctcacctgagcttccatttctactttaaaaatatttgtcaattagaaaagtccaatttaaaagccaaactttctatgatgactcaaattaagatacacaaattctctgtcatttctttgacatttactttgaattattggacgctttaaaagcctttcatagacttgatatgtacaggcaaattaacttactttcagtgttggtatctttatttttatccttcagatataaagagaatattatgaaattatcaagaattcaacatgatcaaccagtaaagcccctggatcgagcagtcttctggattgaatttgtcatgcgccacaaaggagccaaacaccttcgagttgcagcccgtgacctcacctggttccagtaccactctttggatgtgattgggtttctgctggcctgtgtggcaactgtgacatttatcatcacaaagtgttgtctgttttgtttctggaagtttactagaaaagtgaagaaggaaaaaagggattagttatgtccgacatttgaagctggaaaacctgatagatgggatgacttcagtttattccagcaagaaagattgtgatgcaagatttctttcttcctatgacaaaaaaaaatctttttgaaatctaccttgtcaagtgaaaatttgtttttcagagatttaccacccaagtaatggttagaaatattttgtggcaatgaggaaaacactagggaaaataaaaaataatataaagccatatgagcttatattgaaatttgttgcacttatattgagatttgttgttttaattcgcaagttacatgaaaaaaaattactcagcttaactatatttcacacattttacataaacacaagaacattaagaagtctactgacagtatcagtactgttttgcacatactcagaataatttggcttcattttgcacaggattctgttgttttaactgttgctaaagaaactattacatagttaaattgtatagaaagtttctctctgccttttgatattttgagataagtagtattgcttcacttttacactccatgcagctttattgtctaattttttgctaaaattgatggccaaatgtttactgttttaagaacttaagtcatttctcagtggaaattatgtggaattagaaatatagccactgttacctgcttcctactgtaaaatttaactattttgccacatctttggtttcatgagcaaattctattttttccagatatttaaacatatttgtctggttgattttattctcatagttttaattacttcaatagttatttgggaacaggttgtgtttgattagatggataagttttttagtggtaatttctgaggttttggtgcacatatcatgtgagaagtgtaccttgcactgaatgtatagtctagtatcccttgcccccctcccaccctcccatctgaatccttagagcccattatatcattcttatgcctttgcatcctaatagcttagatcccacttataagtgacaactgatgatgttgagttttctattcctgaattacttcacttagaataatgctctgccacttcatgcaagttgctgttaatgccattagtttgtttctttttacagcttagtagtattccatggtatatatgtatatatagtatctatatgcatgtgtgtgtatatgtgtatgtgtgtgtgtgtgtgtgtgtgtgtgtgtgtgtgtgtgtgtgtgtgtatcaggggaacccaccctcaatatttcaatggagtttctttctattttccataagtgttggctggctgagaaataaagataaagagtacaaagagaggaattttacagttgggccaccggggttgacatcacatattggtaggactgtgatgtccacccgagcctcaaaccagcaagttttttattaagggtttcaaaaggcaggggtgggggggtgtaagaacagggagtaggtacaaagatcacatgcttcaaagggcaaaaggcagaacaaagatcacatgcttctcagggaacatggcaaagagcaaagcagagctactgataagggtccaaaaaagatcacaaggcaaagggcaaaagcagaactactgataagggtctatgttcagcagtgcacgtattgtctttataaacatcttaaacaacagaaaacagggttcgagagcagagaactggtctgaccacaaatttaccagggtgaagtttttccccaccgtaataagccggagggtactgccggagaccagggcatatctcagcccttatctcaaccgcataagacagacattcccagagtggccgtttatagacctccccccaggaatgcattcctttcccagagtactaatataaatattccttcctaggaaaagaatttggtgatatcttccctacttacacggccatttataggctctctgaaagaagaaaaatatggctctttttgcccgaccccacaggcagtcagaccttatggttgtcctcccttctcccctaaaaattgctgttattctgttct

SEQ ID NO: 14339 - DNA, 18798 bp, Human
tcccctggccctgactggaagcctagttttctctctcatgaccagctaggcccctagctccccagggaagaaatccaatctatttcctctgatagtaatggctaatacttaaataatgccaaccacatgccaagcactttacagttgttagcccagtcttcacaagcaccttgtgaggtgggcaagagtcttatcttactctcattttatagatgtggcccaggatcccacagctatagttcatggtgctgggatttgaacctctggccaccagagcccaccttaatgtgtcctcctcctgttgtcataacagaaaagtacaacaccatgatgacacatcaggctatcctggcaggttcccaggctgccccaatgcccaactttctaggtttacaaagttgacatttacgaagtttccaggtttacaaatctagtttctgattctttagtcagcaggaatttctctacaaaagctgcttcgaaaatttccagccaaaccttacacaccttggcattacatcttggtgagccaaggcggaagagaacaggaagtgaaggccccatgggaagtccctgcggtcgggagcacccaggcggggcggggggtggggggctttcctgtggccggctccctgcccctcccacccccattcaggccctgtgagttgaatgaagagaccctgggaatgagtccaggtctgcagggttagaggaaattgaaggcccttaccagatccctgttgagaagtttatgaattatgagcccttctgcaaatgagagggttcttccctgtcaggagggacagattgtaggtggcaagattggtggcagccagtaggctggtctgctccttcctctctatttcatatgtgtatgaaggcattacctgcagcaagggcctgtgtaaatgcatgtgatttacagagcattttatgtactgcgtgtcattcatgcttccggtgagccctaagtctaagatagggcagatagcatcaggtccattttgcagctgtcaaaatgaggtctgaagggcagaagtggtgtgcccacacacacacaactggttggctgcagacctggggactagacccgggacttcgtcctgcccaggggtctcttgccactgctccccatcaacttggatggctttaagcatttgtgagttgtctgctccctgatggcagaatgcagagacatgaagctacaagcaggttcgctcccaacggcaaaaaggaggaggggtgttcagaacatcaggtgcttctagagaaagcagggagagagtatctggccttgtggacaatgtcacggcagaggccaggtatagggcatgggggtaactggaagcgggatggaccctgttattccctaagacatggcttccacgtagtgctcaaacaaggcctttgcccttgctgttccctccacctggaatattcttccccttccttgacattgctcaggtctccactcttatgtcaccctctcagagagggcttccctggccactttccctaaaatagccacccactcctaggtccctcaaaagcatatcctgctttggattttccctatagcaatatgccctatgaagttattttatttgttaacttgtttcttgtctgttttcctttgttagagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaaggcccagctcagttctctgcatgtgacctcccatcttacgcagataagaaccagtttggtttctgctagcctgagtcaccctcctggaaactgggcctgcttggcatcaagtcagccatcagccggcccatctcctcatgctggccaaccctctgtgagtgtgtgggaggggaggctgggctcctccttgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttaggtaagctccttccactctcattttttcacctgagaaatgagagaggaaaatgtctacaattggtgtttatcaaatgctttcaggctctggtgagcaagcgtccaggaaaatgtcaagcgcatggagctccaggcctgtctgggggatctgggcacggggaggcatccatgggagaccatgcaggcactctgaggcaggggctgcaagcctagtgcctgctggggcagcaggtgaacagagaggtgtaactgctgtgacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacaggtcagttccaccagttgtcacaagagaatgcaggctcaggtggccagaacttctcgcttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctcttaatgggtcatggacacgttacaagctaggcgccgtgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctatgggggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactcggactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattatttttaggatccaagtttgaaaacaattttaggctactagatatgaacaacatcttgattatgtagttgaaggaaattaaagatgaatggtttaattaaaaattaatcagaatgaaaacgattgattactaatatatctgcaatggtttattttcctgagtggcagactcactaaggtttttgaatactcctgtgtgattgctctatgtatgtatgtatgtatgtatgtatgcatgtatctatctatctgttgtctaataaaatggatcacatctctgctaataaaaacactacactggcagggtacaattataatcattaactgtgcctggaatttgcagcagcagccaccagaggtaccagtgccctttaagggttcataatttagaataatccaattatctgagtttttcagggactgaggggtttggcaaggtgtagaactttcagtaataaagtcaagaaagtcctggacaaaccaaggtagttggtcactctagtccataaccaggtaaagagctttccctgtaacctgtgtaaggttttagaatcatttctttccttattaccaaaaatcctccccaaattttcaagaaattatgaactaaatagttactctatgagataggagttcagcccaaaagaaacaccataagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcttcttcttcttcttcttcctcttcttcttcttcctcctcctcctcctcctcttcttcttcctcttcctcttcctcttcctcttcttcctcttcctcttattcttcttcgtcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacaggtaagcaacacagttgtccccttccccatggtgtctgttcttctccatttcctcctgtctgcagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacagtaagttaaccatgtagatctgagaggagagtagcttcttgtagataacagttggattatataccatgtcctgatccccttcatcatccaggagagcagaggtggtcaccctgatagcagcaagcctgggggctgcagcttggtgggtagaggtactcaggggtacagatgtctccaaacctgtcctgctgccttagggagcttctaataagttgatggatttggttaaaattaacttggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaagctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcggggtggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcgggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaaaagctagacaaaacatatttccaaaagatctctttggaggcatcagagaatggccaaggctgtaaggaactgcctgagcccagagaggtggagcccagcactggtgccctttactcctggggacatgtgctggtttcaaaaacttcagctgagcttttgagcattcatggaacttggtgggggagatgaaatttgtaccttaaatcctgcctacagggagggtccctgataatccccacccaatttggaaatctgggtcagccttcacaggtactgaagccctcctctgaatgatctcaagtcctgctagggtagaggttacctgcttttgaaaggctcctggcctacctgtgcagcaggagcaaaagtgaaccatctcagggtacagataacaatcatccagagccttgaatgacctctactgtgcttaatatatagtattcagcagtcagtaaaaaggatttaggcacatgcaagatgacctgtgtatcagggagaaataggcaataaattgagatccagcagggatttgaatcatggatttgaatcaggggcagccttcgaaagaactatggagaatatactcagatttaaaacataagattggaatttttggcagagaactaacaactgtacaaaaaaggaaccaaatggaaatcctagaactgaaagatgcaattaaccgatgttgagaaatagccaacatctattgaacacttcccatgtggacagctgtgctaaacactttacaggcatcaacataagatgtgtccccttacagcagtgcagtgtccctcctaagacatggacagcctggtttccctatctctctgcttcatcaaaacccctttacgtggggcttagacactcctgttgtctctagtgtctagtagcacagggctcagcacatggaagccactagatacaatttgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagagggagagagcttcccttgtcccctttcttcctctccctaagccacagtgattgacagcccccccctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctctgcacattgtgtggggtaatgacacagggggattcagacctagactccataactcctgccccagggaccacccccaccctcaccctgtgcatgtcgacaaaggacagactgggccacttctcaggacacagcggggaaatgacacagagcagggaggttccaggagccccgagcgtcttttctccaggagaatactctctgaattcagactggggtcagagaaacatttacccaggagccgcagtgtgggtggggctttttacttgaaacgctgtctgaaggcagtggccaggatggaactctccaccctaccttggcaagccacttctcttctgcaatctgtaaggacattgttgagagaattatggtcttccaattccggagggttgaagaaagacaaataggagagaacctatcatagtcaggtgctagctgccttctctttcagagagtgtgagaataaagtgatacacttgattattagcaaatactttggaaattttaaacgctaatattcaacacactctggaagaggcaaataagtagacaggttcatatacatcatctccttcagctagtcctcacaaaaacaaacaaatgaataaacaaaattcttctttggccctcataggaagacactgtttcttgaacgtgtttcaaaaaggatgggtgactcactcaaggtcacactgtttatgaggacagtacaggaatacagacatgccattttgcctgaaaaaatccatcacccagggaggtgacacaattttgcagaaatgttctatttcctctgaaggatacattctttaaacctttgggaaattcattcatagtcttcctcctttgaaggattaactctctggacacaaagtgtttgattctgatttgttggttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttgaaacacgtttgagaaatagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgtgtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcaggtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaggaggtgaggcacaggtcccaggtcaggctggccggagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacacgtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggatctcaaatcaccccaaaacccagtggcttgaaacaaccaaaattttttcttatgattctgtgggttgaccaggattagctgggtagttctgttccatgtggtggaacatgctggggtcactttggaagctgcattcagcagagtgcctggcttgcgctgggcatccaaggtggtccctcatcctccaggctctctttccatgtgatctctcagtgtttaagagttagttggagcttccttacagcatggcggctgacttccaaaagggattattccaaaaagagcctcaacatgcaggcgcttattatgacttctgcttgcatcatcctattggccaaagccagtcacgtggctaagtctagccccctgtgagaggagactgcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaaccttaacctcaatgtgagtggccatactgtggcactgtcccatccctcaccagggacactgttctggagggtgactgcctgttctgtgaggagtggggatggctaggacattgcatggaacacaccaccaccccatcttctcagagctcaaaccctgacagaacaccagctccacaggccttggcttctgctgatggtgccgtgtatttaccagacttagtggtccaaggccagagtggccagatttcccaaagtcaaggtgtgacagtgggacagcctctttgtgtctttgctgtcctaagaaacctgggccaggccaggcgcagtggctcacgcctgtaatcccagcactttgagaggccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggcgacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctatattgttgactatgtccttggccttgacaggctttgggtatagagtgctgaggaaactgaaagaccaatgtgtctttcttaccccagaggctggcgcctggcctcttctctgagagttcttttcttccttcagcctcactctccctggataacatgagagcaaatctctctgcaaaaaagatatggggcagcactgtccacaacagcctctactggaaacaacccaagcacccatcacagaatgaattagtacatcatgtatctgcacacaacacagtgctccttggcaaagaaaatgaatgaattacagccagctgcacctcacaagacagataatcttacaaacatcatgtgggtacaagaatcacaaaagcatgcatagagtgtgattccatttctacaaagttcaaaacgggcaacatggggctgttgtgtggagggctgtggaaacaggtggtgcagagagaagcaaggccatgctctgtctgaaggcccagtgacacttggcccctgcgagagagagtggcaggcaggagcacctgggggattttagggtccagacaacattctatttcttggcatggatgcagttaggcggttttctgtatgtatattttatttcacaatacctagaaaataaaaagacttgccccccaacaaccagggtgtaaagaaaggagcatctgggaaattatgagattagtgaatggagtattgaatttgtccccataggtgggagtgcaagaccatgagtgaccacttatcaaacacacctcagtaaacagtcaggagagtgaggagtgtggtcctttcacctgcccaggttgtttctgttagattctgggcttggtctctg

SEQ ID NO: 14340 - DNA, 529885 bp, Human
  misc_feature (1)...(529885): n = A,T,C or G
ccctaggagtgctaatagaagaatccctctgctggttggctctccaacacccatgagcaagaatgtatgcccttgtgcctgggggcattcatactagcctatacagtcatggcaggggttcatttgctaccccatggttatcatatggggttagagaaatatataaatcatcaaatacaatcatcaagttgctcaccccccttgagttataagtgattctgtgaagtgactctgttaaccatctaccccgaatgccaaactccactgaggcataaccatgcaatgaggcataaccatgcattcgtatcccagtggtagagacattaagtgtttccattaccagtgataaattacagttttgttactaaagaaagggcagacaagacccacacacttttacttctaatgtgacttgtatgaggagggaagaaagccaatgccaacaagcccccaaatgtaacttggcctgggtgtagttaggcaggggagcaagagctctttttaaacactgtgcctgtcagcagcacacctgattgacagccgctgaaaatacttaagaagctcagggtgagaagagatggacagcgatgggggatgggaaactagaatcgaactctgtcttcagacagcagatagctcattaaagctaccggaaaaaaaatctctaagggtgcagtctgttcggctgcgtttacaaaaaacgagtacagccaagacctgggagcccgacgccctttgtggagacaacgaattctcctaattagatttcatgacgtacctcctccaaaatagctgaacacctaggaacaccaaacacgcttttcaaagagtctaagtaaattaacttttcccctgaatatgtcatagggaataaaggaagtcttccagaatcaaacttggacaattctggtagatatgcaagaggaatgttcgtgtccaacatctgtatttataatttcattgtattttttctccaaaataaaagaaatggtagagtcacctttacatttatataaaattatcttcatccctaagtgataaaagaggacacaaacacaaagtagacatttccaacattctgtctgctccctgctgagatggttgtaagttgcattgcaaagcttaactgttacatcaaaaagccctccaagagggcgaggctttgcgctttatagattccaggggtccgacagcgggagaagctgctttcagactcatctccttgccgggaagattgatttccccagcgttctccagcttcccaggactgtggccaccgcgctgagacccgaggcgtcccagagcgggacgcggagacagatcgctttgtgagcgccaatctctgcagcctctgggctgaagctgcgcccggcgcctgccccctacccggcctcactcacccctcctcctagagcacgtttccgcacgtgctcaggaccccttccacggcaaaggctcctccccctccactttcttagtaggtctccatctccagctcattcatcggcagccactgcttttagacagtttcctatctatccttcctttttaaaaacaaaaacagccgggacagggcggggtgggggggcgcggggagaaaaggcaggagatttaactccaacttcagagcaatcgtccccggctgcccatctgacaccagtgggtggggtgcaatctgacacttcccttcctttccagaaacgtgagtggagctggcgcgacccttgatctgggggtggggagacgggggagaaggtccgcacttccgtcctcacgactttctccccaggagacccggtatcagtggcgagctgccttctctcctcgccgcttgcaggtttggcgcctggaaaactcttcacgttctgctttctcctgctcctggctccgccccagctccagccccggcattcctccagctctacacgtcctggccgcccccttcccgctgcctctagagcgagcgtacggggtcatctccgcgtctgccctgggcccaaggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaaccagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttcctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcacccgtgttggccaggatggtctcgatctcctgacctcatgatccacctacctcagcctcccaaagtgcttgggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggactttgtcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaagggagtaaaaagaaaaattagaaaaatgggcttacctggcagggaacagaaatannnnnnnnnnnnnnnnnnnnctgcagatagcagacagcctttctttctgctgtcttgcaatgtatctccccttctcctctaaataaatctgcctttctaaactcattactatcttggtaaattcctttaccaccagtgcactggcttcagataatcatcaaccatgacaattatattgagcctacctaggataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagtactccatctcaagtaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttggttttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagcctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctcccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcagctacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatgttcccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtgggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctccctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttgctggtgagggctgctgtctacataaaaatgatgctgtctgcatcctccagataggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatgggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactggtatgggaaggaggaaccctccatattatccccggaggacaacaaaggcttgctggtgcaaaaaggtgacattttgaaggataacaagggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctggggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgcatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatctttttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaaacgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttttttttttattcccggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatctttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttctttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttggatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatcccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctagggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacaggattcagttcctggtgaggcctctttacctggattgcaaatggaccctttcttattgtgtcctcacatggcagagagagagagagagagagagagagagagagagagaaggagggagggggaagggggtgggaggagggaggcaccactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatggagggttccagacttccttttcaggttcctcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgcctcttcatgccacttgggcttgatccccagcaacagaccaccctgagtgaatgccctcctcatgatacttgatacactgtgctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagataagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttatttattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatatagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtagatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacataacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttctctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcagcagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaaaaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataatttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatctttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctacccaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagaaagaaagaaagaaagaaaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttacttacttgcattttctttttttacataattaattttatcactgtctcttctctgtgaattctttcataaaattaatcttcagttcagcgttggatagtcagtcatctgtatgcgtttctttttaatgtcatttcattgtttcaaccttaatttttttaatccatctggaatacatgttatatatggtataaaatgtgtaaattatttgtttggttgttttatatttatatttatattccctttctcattgttttgtaatatctcccatattacattttaaaagcacagtgcatttttaaatgtaatgccctctagtgctgattccttttctaactatatctcactgtatcctgtgaagagccttactccattttccttttccagtttcagctgtcacctgtttcagctatcatttgtttctttgtaaatactcacatcccccactcccctgtccccaacatggccttgttcttgttccttgtctgctttttaagaagtggagggcagagcagattcataggaaaatggtagtctgggtacacatgccccaaggactcctcctttgccttgcaaaatgcactgttatttctttcccttcagtttcctaaagaaagttgtatcctttagggaaagctaactgctgtaacaactccgaaatggggcagtggcttaacctattacaactggatttctccctcactgtcccagtacagtgtggactgtgaggggtgaggaggggcgggagtgtgtgaggggagggaatgctgtcttccacatagtcactaaggggcccagcctaggctccacatatccagtggctccaccatcctcagagccccgggagtcttccaagagtttcagagcctagagagtcttcatgctgggctggtagttaagggaagggggaaagcaaagatcagtaggaaggcattcgtttagttttttttttttaatttttttttttttttttgtgacggagtctcactctgtcacccaggctggagtgcagtggcgcgatctcggctcactgcaagctccgcctcccgggttcatgccattttcctgccttagcctcccaagtagctgggactacaggcacccaccaccacacctggctaattttttgtatttttagtggagacggggtttcactgtgttagccagggtggtttaatttttttttttatttttttttttagttcaggcctagaaatggcttacatcacatctgtccacatttgttgcccagacctcatttctgtggccctcctaactgccagagaggctggaaactgccatgtaggaagtaaaggggaacgattgggtgatcaccaagtcagcctttcctgcattgatggtaggagaatatgcatagtggctggcctgccttctggcatggaatggggtacttgagattcaagtaacttcattgatgcaatagaaacatgaaaacattataatttgtatctctcctggattacagattgcattgaacaagaagggaatgcttctttcaccttctggattctgaaaagttttcccagccatgtagaggggccctttcctgaaacacaaattggtggcaaagccaattattaatatagtctgacgtctcagctaacctgtcagagtctaggcatatgaattgagccgataatcaaaaagcatttgtctttttttgttttgctgggaaggttgttttcttcaggtagcagcagctaagagcatactgtgctgtttcagttttagaagtccggggggacgtcgtagaagtgggaaggaaataacaggatttgaatccccagcaaggattctacaaactgattccatttcttgggctttctctctggcttccaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaaggctttgtttcctggctttaaatctcttgaatgaatttgcatcacatttcagacatattcttcactatccacagatccaagtgtaataaatcatggcaattctatgcatatacatatatagcaaaaaagctggtttaaaaatatcagatggctttgggacatcaactcagtgacaccaaagcatttagaaatgtataataatttgttgcaagtaaaggctgatttcctcgactgttgaagaggtggttttctacaggactgaaactcaggtttcctgagtttcctgaactgtgttgggcagctgttgcccaacgcaattcctgttaagctacacctgctctgtgggccttagatgcctaatttgcttcagggccgaaataataaaagctagaagtggcatgtggtatttcttatttgggaatggtttgagatagcttcaggctctgccatccggtccagcacttccaccactggctgggactcagggaggatttgcctgcagacctctggttcttcctgactgcccacactcagccaaaagttgtcaacaagatccagaggaaatgctgcttggttgtggatcgcaggtggcttttctgtgccacctactctcatcctactcctgctgatgctacttccctggctttgaatttgaccatgatctgatcagttctttccctccttcctagattggatggcctgataaatgcgactctctttctaccatgttcttgctagagtagtcctatttttaaaaaaacatccagatcaaatggccctgaagttgatgcctgtgtcagaaaaggtcacgaaaagtatgtccatctgttaatagatctaaaataagcagtccagaaaacaggactcacaatatcttttacatatatctcaatattcactctccctctctttgtacatttaagcttaggggccatgtctttagcttagtgagttacagcttgtttctttttctcttttgagatggagtcttgctctctcacccaggctggagtgtagtgctatgatctgtgctcactgcaacttctgcctcctgggcttaagcgattctcctgcctcagcctcctgagtagctgggattacaggcgcacaacaccatgcccggctaatttttgtattttagtagagatagggtttccccatgttggctgggctggtctcgaactcctgacctgaggtgatccacccgcctcggcctcccaaagtgttgggattacaggtgtgagccaccgtgccgggccttgtttcttaaatgcctttatcatattgaaaataagcagtttaaaaaaaatcgtacatgaaacccaaagacctgagggaaattatcctttctaataccttataaatgatataatacctgacaagaaaaaaataaaaaactctttcaagctggccaaaatgcctttaaaaggctgttcaagtcactcattccccatgaacagacagcttcaacaagcatgaaaaaagcttcagtgtgtcacatatgtttctccatctatgaatactctgacattgacattgaaacaatatgagccattgtttttgtgtctctggcaaaggggccagaatggggatggcagaaatggccaaatacgaatttgtcttgatccatctaagtagctattaccatatgtttgttgtgggtttttatagaaaaaaaaaccctcttataccaatggaatttgtgcaaattgaggaaatttctaaataaacccagcttgcttcttttcttatgcacattttaatacacatctgcttggcagagaaacagcattgggattaaatataaagggacgtcagaacaaagtccaggcctgtggggtatgttggtctgataagcaaactgggggaggtagattatactgaactgagaagaaaggaaatgactgaagaagagttacacagaggttaaaacaggacatctcaactgagaattttaaaacagaactaaatcagtagcaaatgttcttcaagagaaaaaaa

SEQ ID NO: 14341 - DNA, 529885 bp, Human; identical to SEQ ID NO: 14340
  misc_feature (1)...(529885): n = A,T,C or G

SEQ ID NO: 14342 - DNA, 529885 bp, Human; identical to SEQ ID NO: 14340
  misc_feature (1)...(529885): n = A,T,C or G

SEQ ID NO: 14343 - DNA, 529885 bp, Human; identical to SEQ ID NO: 14340
  misc_feature (1)...(529885): n = A,T,C or G

SEQ ID NO: 14344 - DNA, 529885 bp, Human; identical to SEQ ID NO: 14340
  misc_feature (1)...(529885): n = A,T,C or G

SEQ ID NO: 14345 - DNA, 529885 bp, Human; identical to SEQ ID NO: 14340
  misc_feature (1)...(529885): n = A,T,C or G

SEQ ID NO: 14346 - DNA, 529885 bp, Human; identical to SEQ ID NO: 14340
  misc_feature (1)...(529885): n = A,T,C or G

SEQ ID NO: 14347 - DNA, 529885 bp, Human; identical to SEQ ID NO: 14340
  misc_feature (1)...(529885): n = A,T,C or G

SEQ ID NO: 14348 - DNA, 151089 bp, Human
  misc_feature (1)...(151089): n = A,T,C or G
ttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctacccaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagaaagaaagaaagaaagaaaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccat

SEQ ID NO: 14349 - DNA, 132438 bp, Human
  misc_feature (1)...(132438): n = A,T,C or G
acagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctacccaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagaaagaaagaaagaaagaaaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttacttacttgcattttctttttttacataattaattttatcactgtctcttctctgtgaattctttcataaaattaatcttcagttcagcgttggatagtcagtcatctgtatgcgtttctttttaatgtcatttcattgtttcaaccttaatttttttaatccatctggaatacatgttatatatggtataaaatgtgtaaattatttgtttggttgttttatatttatatttatattccctttctcattgttttgtaatatctcccatattacattttaaaagcacagtgcatttttaaatgtaatgccctctagtgctgattccttttctaactatatctcactgtatcctgtgaagagccttactccattttccttttccagtttcagctgtcacctgtttcagctatcatttgtttctttgtaaatactcacatcccccactcccctgtccccaacatggccttgttcttgttccttgtctgctttttaagaagtggagggcagagcagattcataggaaaatggtagtctgggtacacatgccccaaggactcctcctttgccttgcaaaatgcactgttatttctttcccttcagtttcctaaagaaagttgtatcctttagggaaagctaactgctgtaacaactccgaaatggggcagtggcttaacctattacaactggatttctccctcactgtcccagtacagtgtggactgtgaggggtgaggaggggcgggagtgtgtgaggggagggaatgctgtcttccacatagtcactaaggggcccagcctaggctccacatatccagtggctccaccatcctcagagccccgggagtcttccaagagtttcagagcctagagagtcttcatgctgggctggtagttaagggaagggggaaagcaaagatcagtaggaaggcattcgtttagttttttttttttaatttttttttttttttttgtgacggagtctcactctgtcacccaggctggagtgcagtggcgcgatctcggctcactgcaagctccgcctcccgggttcatgccattttcctgccttagcctcccaagtagctgggactacaggcacccaccaccacacctggctaattttttgtatttttagtggagacggggtttcactgtgttagccagggtggtttaatttttttttttatttttttttttagttcaggcctagaaatggcttacatcacatctgtccacatttgttgcccagacctcatttctgtggccctcctaactgccagagaggctggaaactgccatgtaggaagtaaaggggaacgattgggtgatcaccaagtcagcctttcctgcattgatggtaggagaatatgcatagtggctggcctgccttctggcatggaatggggtacttgagattcaagtaacttcattgatgcaatagaaacatgaaaacattataatttgtatctctcctggattacagattgcattgaacaagaagggaatgcttctttcaccttctggattctgaaaagttttcccagccatgtagaggggccctttcctgaaacacaaattggtggcaaagccaattattaatatagtctgacgtctcagctaacctgtcagagtctaggcatatgaattgagccgataatcaaaaagcatttgtctttttttgttttgctgggaaggttgttttcttcaggtagcagcagctaagagcatactgtgctgtttcagttttagaagtccggggggacgtcgtagaagtgggaaggaaataacaggatttgaatccccagcaaggattctacaaactgattccatttcttgggctttctctctggcttccaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaaggctttgtttcctggctttaaatctcttgaatgaatttgcatcacatttcagacatattcttcactatccacagatccaagtgtaataaatcatggcaattctatgcatatacatatatagcaaaaaagctggtttaaaaatatcagatggctttgggacatcaactcagtgacaccaaagcatttagaaatgtataataatttgttgcaagtaaaggctgatttcctcgactgttgaagaggtggttttctacaggactgaaactcaggtttcctgagtttcctgaactgtgttgggcagctgttgcccaacgcaattcctgttaagctacacctgctctgtgggccttagatgcctaatttgcttcagggccgaaataataaaagctagaagtggcatgtggtatttcttatttgggaatggtttgagatagcttcaggctctgccatccggtccagcacttccaccactggctgggactcagggaggatttgcctgcagacctctggttcttcctgactgcccacactcagccaaaagttgtcaacaagatccagaggaaatgctgcttggttgtggatcgcaggtggcttttctgtgccacctactctcatcctactcctgctgatgctacttccctggctttgaatttgaccatgatctgatcagttctttccctccttcctagattggatggcctgataaatgcgactctctttctaccatgttcttgctagagtagtcctatttttaaaaaaacatccagatcaaatggccctgaagttgatgcctgtgtcagaaaaggtcacgaaaagtatgtccatctgttaatagatctaaaataagcagtccagaaaacaggactcacaatatcttttacatatatctcaatattcactctccctctctttgtacatttaagcttaggggccatgtctttagcttagtgagttacagcttgtttctttttctcttttgagatggagtcttgctctctcacccaggctggagtgtagtgctatgatctgtgctcactgcaacttctgcctcctgggcttaagcgattctcctgcctcagcctcctgagtagctgggattacaggcgcacaacaccatgcccggctaatttttgtattttagtagagatagggtttccccatgttggctgggctggtctcgaactcctgacctgaggtgatccacccgcctcggcctcccaaagtgttgggattacaggtgtgagccaccgtgccgggccttgtttcttaaatgcctttatcatattgaaaataagcagtttaaaaaaaatcgtacatgaaacccaaagacctgagggaaattatcctttctaataccttataaatgatataatacctgacaagaaaaaaataaaaaactctttcaagctggccaaaatgcctttaaaaggctgttcaagtcactcattccccatgaacagacagcttcaacaagcatgaaaaaagcttcagtgtgtcacatatgtttctccatctatgaatactctgacattgacattgaaacaatatgagccattgtttttgtgtctctggcaaaggggccagaatggggatggcagaaatggccaaatacgaatttgtcttgatccatctaagtagctattaccatatgtttgttgtgggtttttatagaaaaaaaaaccctcttataccaatggaatttgtgcaaattgaggaaatttctaaataaacccagcttgcttcttttcttatgcacattttaatacacatctgcttggcagagaaacagcattgggattaaatataaagggacgtcagaacaaagtccaggcctgtggggtatgttggtctgataagcaaactgggggaggtagattatactgaactgagaagaaaggaaatgactgaagaagagttacacagaggttaaaacaggacatctcaactgagaattttaaaacagaactaaatcagtagcaaatgttcttcaagagaaaaaaa

SEQ ID NO: 14350 - DNA, 132438 bp, Human; identical to SEQ ID NO: 14349
  misc_feature (1)...(132438): n = A,T,C or G

SEQ ID NO: 14351 - DNA, 15627 bp, Human
  misc_feature (1)...(15627): n = A,T,C or G
gattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaactggatattctagtctgaacactacactgggtgttagttctttgtagtaagttaggagtgcgtggtggaggttgaaaccgtgaatttaaaactctcgttttccacccccttaatgtggaataacaacagcatttcttaagagtgtgtgtggggaggggaaatgagatcattcctatcaagtgcctgaagcatagtggccggcactggagaaagttctcagtgaatgttagctgcgccttctatgttcttttttcctagggtcatttgttgagattcattgtttacagagtgctgggtattaggcagacctcttttgggagttagggaccttttttaagacgccagtcctacacagcatgaatcagaaggtcatcttcctggagagcattccagggtccctggttaagcaccctagcctggcactgccactagagcctgagtctagaatttgtctcctgagttaaaggacatttctggccatggaaacgaagagctcctcacaaaacttcaaagtggcagtttgagaacaaggagaatttttagaggatccttaaactggtcatatttgtaactggcgtctgcactgtatagacaaagtactgagtggcagatttcaggtggctttcagaggtctgatttgtgttcagttacacttttgggtctcacatttctacatcctgcttctctctaattccagtttctacttcatttttcaaaagccctacacagttttccagtaacttttccctgatgctgccctcccacagagagggttctttcctgtggatagggagcggagtttgcatggagatggcctctgtcgttagtatgtatctcttccaatagttcagagtactagaagctatgattgccacaccaaaccggaccagttacttacttctaatttgtgttcctgtttctaactctagaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatagtgagtgaccagttggtctggtttgaatttagtggctcatgagattatatggcccttttactgtccatgtcatttcctttcccacctgttagagtgagaaatgccaggactagcttagtgattaaacagtcttagttgtagtcccactaacagtgcaggaaggcctttgagaagactttcctagcatttgtggtcattttattctctgcttacccacagcaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacagtgagtactttgagaaagtagatggtacagtagagataggaggccacgctgagagtggagatgtttaattttattccacaaaaattattattattattttttttaaatggagtcttgctctgtcacccaggctggagtacagtggcgtgatctcggctcactgcagcctccgcctcccgggttcaagctattctgcctcagtctcccgagtagctgggactacagacacccaccaccacgcccggctaatttttgtatttttagtagagacggggtttcactgtattggccaggctggtctcgaactcctgacgtcatgatctgcccgccttggccccccaaagtgctgggattataggcatgagccaccgcacccagcccaaaaattctccttgtcatctgattactccacactcaagtatctatcttttctcctaggaatcagtatcttccaacaccttagagcaggttcagagaaggggtggaagagaaatatgaaaattttggttgggggagggagtaattcctctggatgtcttcatttggctcaggctgagtgtggggcttggagtccctggagtgccctggagttctctgaggggcaggcaaggtgtaaataatatcttggaacttttagaataaataaaattgatttttttttgagagattataagtgtaaatgggctgggtacagtggctcatgcctgtaatcccagcactttgagaggccgaggtggaggatcacttgaggctgggagttcaagaccagtctgggaaatacagcaagaccccttctctacagaaaattttaaaattagccgggcatggtagtacatgcctgtagtcctagctactccagaaagctgagacaggaggatcgcttgagcctaggaaatgaaggctgcagtgagctatgatcgcaccactgcactccagcctgagtgacagagtgaggccctgttactaagaaaaaatagtaagtgtaagtagacagaaaggagttaaagaatctatgtgtatctcaagtagaaaacctagtactggtcctttctttagatagtctttaaaagtttggtagaaggtataaaaggcattgtattgggtctgctattcagccttacttatcattcccttcttttctctttctctcatttctagattccttatggcagaaagtatgacaaggcatggctcctgagcatgattcagagcaagtgcagtgtgcccttcacccctattgaggtaagacaaggcctgagtggctggctggccaggcaccagggatggtgaaggggcaagctggactcccagcgtaatgcccctccccaagggctctggactcccagtgtaatgctcctgtttcctcttgtagtttcactatgagaatacacgggcccagttcttcgttgaagacgccagtactgcctctgcattgaaggctgtcaactataagattttggatcgggagaaccgaagggtgtgtttaaagggcctggcttggctggaggtggaggttggtgctcagagcagggactgggtcttgttcttgcggcttaggcttccctagagttttctgtgccctctgtgtcttccctccagatatctatcatcatcaactcttctgctccaccccacactatactgaatgaactgaagccagaacaagtagaacagctaaaggtgaggcaggctcaaattagatgtttccaacccagtcttactacttctcacacccccaccccccacacacaaacccagtgaccactaaacccttctttttcctctagctgatcatgagcaaacgatacgatggctcccaacaagcccttgacctcaaaggcctccgttcagacccaggtatggttgacagcagtagttctcagataggtggtgataaggtgggatctgtcagggagggaaagtttgaggatgttttactgctaatgctggcatgggcaaaccctctcagtcttccctttccttcccttctgcttcctgaagatttggtggcccagaacattgacgttgtcctgaatcgcagaagctgtatggcagctaccctgaggatcattgaagagaacatccctgaggtaaggcctttggcccagtattaggcatgaggaagcagggtgtgttagataggaagtggctggagggcagattcgtctctgatccacttgctggtggtgcctcctctaaactcttctctcctcacagctattgtccttgaacttgagcaacaacaggctgtacaggctggatgacatgtctagcattgttcagaaggcacccaacctgaagatcctaaacctttctggaaatgaagtgagaattgatagctcggctatatttttgaaggggtgggtagagggtgtagagagtttgtccagtgatggcaagaggcaagagagagaactcaggccagatgtgctggtttgcaactctaatcctaacactttgggaggccaaggcaggaggatcacttaaggctaggagtttgcacgcctctagtccaagctgccccagggggctgaggtgggaggattgcttgagctcaggagttcaaggctgcagtgagttatgattgtgccgttgcattctagcctgagcaacctgtctcaaaaaaatttttttaatttaaaaaataaattagtcgagcatgatgtcacatgcctgtagtcctagctacccaggagtctgaggtgggaggatctcttgagtccaggagtttgaggctgcagtgaactatgatcatgccacggcactgaacttgggtgacagagtgagaccctgtcccaaaaaaaaaaaaaaaagaaaaaattttaaaagattagaaaagatctcagagctaagcgtagggactgggggtatggggagccagctggctgtcttcaccagggtctcctccctttgttccttccaccctttgcagttgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctgaaccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggtaagtccataattttttcattctaacaagcacagcatctctcactcacaaggattcctggataggtttctttttctttttctttttcttttttttttttttatttgagacggagtttcactcgtcgcccaggctggagtgcaacagcatgatttcagctcaccgcaacctctgcctcccaggttcaagcgattctcctgcctcagcctcctgagcccaagtagctgggattacaggcatgtgctaccacacctggctaatttttgtatttttagtagagacagggtttcaccatgttggccaggctggccttgaattcctgacctcaggtgatccacctacctcggcctcccaaagtgctgggattacagacgtgagccactcgcaccaggccctttttttttttttttttggatggagtcttgctctgttacccagagtgcagtggtgcaatcttgactcactgcaccgtttgcctcctgggttcaagtgattctcctgcctcagcctcctgagtagctgggattacaggcatgtgccacaatgcccggctaatttctttgtgtatttttagtagagatgggggtttcatcttgttggccaggatggtcttgaactcctgacctcaactaatccatccaccttggcctcccagtgtgctgggattacaggtgtgagccactgcgcccagcctggatccctggatacttttcatgatgcgtttacacttgacttctgacccttctctcttagttcttcagtctacttatgcacccagcctttttctctctggtttaaactgtcaactttcttttttgtttgttttgttttttgagacagggtctggctctgtcatccaggctggagtgcagtggcacaatcgtagcttactgcaaccttcgcctgccaggctcaagtgatcctcccacttcagcctcccaagtagctaggactccaggcacgcaccaccatgcccagctaatttttgtattttttttggtagagatgggttttgccacgttgtccagccaggctggtctcaaactcctgagctcaagccatctgcctgcctcggcctcccaaagttctgggatcacaggtgtgagccactgggcccagtctacactgtcaacttttacttcctttccacaggatggccatgagctacccccaccaattgcctttgatgttgaagcccccacgacgttaccgccctgcaaggtaggaagcatggacagagtaagaacttgtgtgtggagagaatactgcttccatgttcctaatacctgtttgatttcagggaagctattttggaacagaaaacttgaagagtctggtcttgcacttcctgcaacagtaagtatcccagggtcccccctccccaccccgaggttgagggggaatggtgggcagacccaggcacacatcaatctttttgttttgttttttgttttgtttttttttttttttttggacagtgtctcactgtgtcacccaggctggagtgcaatggtgtgatcttggctcactgcaacctctgcctcccagggttcaagtgattctcctgcctcagcctccccagtagctgggactacaggtgtgtgccactgcacctggctaatttttgtatttttcgtacagatgggatttcactatgttggccaggctggtctccaactcctgacctcatgatccacctgcctcttcctcccaaagtgttgggattagaggcgtgagccaccgcacctagccattttttttgtatttttagtagagacagggtttcgccatgttgcccaggctggtcttgaactcctgggctcaagctattcacccatctcagcctcccaaagtgctgggattacaggcatgagcttccatgcccggccacaactcactcttgggagctactgggtccttgtatggctgtagaccacagagcccatactttcttttttgtttttcccataggtactatgcaatttacgactctggagaccggcaagggctcctggatgcctaccatgatggggcctgctgttccctgagcattcctttcattcctcagaaccctgcccggttagtatcacatcccagaatctgcccgggaccactgggtttcccagcagatacagggcacacctgctggcagcactgctctgaacaccacgtccattccttttattcccccagaagcagcttagccgagtatttcaaggatagcagaaatgtgaagaagcttaaagaccctagtaagtgtgtgatacgaacaaaatatgggaaaagggcatgggaaggaatcagtcagaactcaggagtgtgtggcagcaccactgagctttctcctctacccacagccttgcggttccggctgctgaagcacacgcgtctcaacgttgttgccttcctcaatgagttgcccaaaacccagcacgacgtcaattccttcgtggtagacataagcgcccagacagtaagctcctgcttgcgcctgacagaagcctagaattggggtgggggtggcatttaataggcaagggggggcactcaggctctgagaagtgtacattgtacctgatgctgcttctctttcagagcacattgctgtgtttttctgtcaatggagtcttcaaggaaggtaagaatctttagagtcctgagtttgtagcgtggtcccacccccagctggaattttcctcagcactcttagcttcccagctactttctctcccattttctttttgagctccttctcccattctgcccccaagccgtcttggcttggcctacctctccacctgtcctgtctggatgtgggaaaagcctggggattaggaggactttggagtcaggcagttcttagtttccatcctagttttggttgtgcggggctgtggacaagtaacattacctctaagacagattctttatttgtaagatggggttagtaatagccgtctcatagtggtgctataggaagtaaactgaagtgacttacaaagtgcttggcctggggcctggcatacagatgctatcagtggattagtagttattacttttttttgagatggagtcacactctatcaccaggctggagtgcagtggcgcaatcttggctcactgcaacctccgtctcctgggttcaagtggttctcctgcttcagcctcccgagtagctgggactacaggtgcgcactaccacgcccagctaatttttgtatttttagtagagaaggggtttcgccatgttggacaggatggtctcgatctcttgacctcgtgatctgcccacctcagcctcccaaagtgctgggattatacgcatgagacactgtgcccggccgtagttattactattgtcctttctgacctgacccttcaccccacctgtgcttcccttatacccttatatacttaatcattcctctctgacttgctaggattctttatatcaaagaccatgattcaagaagctgtttgtaaacataaagcactagtgaccctaaggtgttgttgctgttcttattgcagtggacggaaagtcccgggattctttgcgagccttcacccggacattcattgctgttcctgctagcaattcagggtaagtattctgcttttcgcattggataccagtcctaatccatggccaacagtgtggtaattggagggtagagtcagtctttggggtgatttcagaaaggcaacaggaaatcagagaaagctcacatagtagttaagagccagttaatagcttggctctggaattgtaccgtctgggttttcatcctggctccaccacttctagcaagtaggctgctgcctcatctgaaaattcatataacaatattcatttcctaagtttgttgtgaggatgaattaaaagagctaaagtccatgcgttgggagaaccctagtgtgtttagtagataatccttccaaacattgattccatgggaggggataaatgataaaaggtaacaatagctaagagtgggagggggaccttgtggatattgaaagaatcagagaataggaatgatgttgggaggatgatgttatctctgtctagctttttaagtgctctttgtcctcaaggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgagtgcggggcatgtgtaggatggggatgcactgaagtagggctagtagtaaataatgagggctcctgacagtttttttgttttttttttggagacaagttcttgcgctgtcatccaggctggagtatagtggtgatcataactcactgtagcctctaattcctgggcacaagctgtcctcccacctcagcctccagagtagctgggcctataggcatgtgccaccttattttattttattattttttttttttggaggtggagtcttgctatgttgcccaggctggagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaacttttggctgcttaaaaaaacctaatagttggctgggagaggtggctcacacctgtaatcccagcactttgggaggctgaggcggccagatcacgaggtcaagagatcaagaccatcctggacaacatggtgaaatctcgtctctactaaaaatacaaaaattagcggggcttggcgttccacgcctgtagtcccaactactcgggaggctgaggcaggagaattgcttgaacctggaaggcggaggttgcagtgagccgagatcacgccactgcactccagcctggtgacagagcaagactcggtctcaaaaaaaaaaaaaaagcaaacagaaaaacacaaacctgatagtctataaaaaatttgcctgtgtataaattaacataaaaaactttaaaggtaaaatggaagttccttttcatatactgttctgcaacttagtttctttacttacaccatgaacatctttccctaccactgtaaaaactatcttgagcttcttgacagctatttaatattccttatctttgagaagccattggtagaacatctggacttttactaatgtctcatttgtataaatagtgcaaggatgtataagaatgtacatatttgttggcaaacttgggtgcttttatggagtggactttcagctggcatttacgagtcagagttcttacagagctgcctgttcttccactccaggtgccttcaggacaacaactgggactacaccagatctgcccaggccttcactcatctcaaggtaaggtctggaaatacagtggcaaaaagactaggatctctgggcctccaggaggtcaggttagctgagtggggttgctgagtggcgagggtaggcctacctctactgaccttcatttttctccaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggtaagacgtgggctggcttcccactgtgacaacgtggggtggcgggacacgaccttccctatacaggcagggagagtcagggactccctatccgagagtggcgggcgggctttaccccacagaaatgtgaaacactggccgggcgcggcggctcaaatgctgggaggccggaggcgggcggatcactaggtcaggacatccagaccatcctggctaacaccgtcaaaccctgtgtctactaaaaatacaaaaaattagctgggcgtggtagcaagcgcctgtagtcccagctactcgggaggctgaggcaggagaatcaattgaacctgggaggcggaggttgcagtgagccgagatgacgccactgcactccagcctaagcgaccgagcgagactcccctctcaaaaaaaaaaattgggaaacagtgatgtctccgagcgccgtgccctgtcatagcctaggctgagggctgcccttcactctgcgaccttgagcaaggtccttaaagctctccatcttcccattaaaatggaaacggacatctattaaggttgttgggaggaataacaagattactgggtataacaggagctcagtactgcactccagcctggccggcagagtgagactcagtctcaaaaaaaaaagcgctcagtaaatactactttcatcccacaaatttcttattcagagggcactggaaaggtcggtacttagatgcccagtgaaaacccctcaccccaatctctgccctgcctgcaggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacat

SEQ ID NO: 14352 - DNA, 7950 bp, Human
gaggggcattctacacagtaactctcctgtgatcttcacactgtgttcaggtcatgaaggtgaagggaagacagagggcctttgtgggtttcaggaccctggagaagcgtgacaaccgaatacggcacatggctcagaaatggatcctttgctataaaggacactattggggcattgggtacattttgcatagggcctgaaggctatttggagttattatatccatgttaatttcttgattatggttataatgcgaaaatgcctttgcatgaaaaacacattaaagtattggggtgttggggtttcatgctgacaacctactttcataggttcagggaaacatatttgtaccgtgcctgcaattcttctgtaaatttgatgtttcaagataataaaaacaaaaaggaaactgagcctcaaaatgttacataacctgactgagtccacatgggtaataagtgacagctctgggtgaaaactcaggtgtgcctttcccctaaagtcacgccctgccctgccaaccacaaggccctgcacatctgagttggcctctgttcctgctcatcacctgcaaaacagccctgcctccccacagccaagttgctggagctgcgccccacctgcccccaccctgcactggcctgactcccccattccacacctggcccagcacccaccacatggtgtggcagacagcactggggcagctgaaagactccatgctacaaattggcactgcccagcttcctgcttctgggagtggggtccattggctgagcttccgctccctggaagagctccagactcctcaatggtttgggatttttcaaaccaattccaaataagccaggggagattttcctgtcttggttcccatcattaccacctccacagttggagattccctcctaatccagatgctcaaaccaggacctcaacaactagggcttcatatatcactgggacacttagcataatcaccattgcaggttgccagacatcacccaaagtgatgttctaccaaagacagaaactgcagctctcccgtgaccttccaggtgctgccctgactcctccagctgaacctgctagggcagagggaagtggaacgtgcagcatatttgccggccactctgcccatgtgcccaccaactcagctgcaggctccagggacacaggctggtgggggggcctggggctcatggctgagccaggtcgcaggacagacaagttggcctggatcaacctgaccaatctcagctggagcagtgagttcttcattgtctgaatctaaaccaggaacccagtggggcttccttagtgcctgtgtaagggctctcggctttcactgctaaggagcttgctaggggcagggtgggtgacctcagccaagggggggatttctcttcttacagaactggagttcctctttcgcaggttctgtgctcccctcaagggtcctttgagatcctccagcctgagtgctcttggggaaacatgctgtgtaaacactatgcccatttcctgcctggagcacaggttttgtggtagggctctcaggggtgaggaggaagcctggcagcccccacatctataaatgctgcgtctaccttaccctctgacttggaggcagagacccaagcagctggaggctctgtgtgtgggtgagtttagccccatcccctaggtgttctccagcttgaggatcgcaggcagagaggaccagcccagcagccacaggcctgaccaaagcccaggctgggaaggagggcaactccccattttccactgggaggtgtttcacagcacagtcaacataggtgacctgcaaagatcctcatgtttgttattttctttggccagatccatccctacagggttcagcagggcctacaggaggggcagtgagagaacagaccccaaaaagaaaggggactccatgactgaccaccttgaggggggccaggctgcgggccccgttcatcttttttcattctcaggtcgctgatttcttggagcctgaaaagaaagtaacacagcagggatgaggacagatggtgtgagtcagtgagtgagtgacctgactaatagcctgggagggacagggcaggttttctgcagagcacggaagattcagctgaagtcagagaggtgaagccagtttcccagggtaacatagtgaggcactgaaagaaaggagactgcactggagcccaggtccccgggctccccagagctccttactcttcctcctcctcagcagcctggagaccccacaacctccagccggaggcctgaagcatgaggccatgccaggtgccaggtgatgctgggaattttcccgggagcttcgggtcttcccagcactctggtctcgcccgccctgcctctcgggctctgcccagcttcctgagtcctgacagagcacagtgggggagatgttggcagaggtggcagatgggctcacggccatccctcctgcaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtgtcaaaggagaccctggccctccaggtactgtgctgcagaccccaccctcagctgagggacacagaccccttttcaggaggcccatctgtccaggcccctaggctgtgggccatagtgagctgggggctatagtaagctgggtgggacttcagtctgcagggctggtgggttcctggggcccttatgatggcgcatcctggagagtctgtcctcatagtgcccacggagtgatagagtgatagctgagccagccctggtgataatgggcatcgagtctcactagctccaaccagttgtgggtgacagatcctacacatccatgtctcttttctctgcaggccccatgggtccacctggagaaatgccatgtcctcctggaaatgatgggctgcctggagcccctggtatccctggagagtgtggagagaagggggagcctggcgagaggggccctccaggtgagcagggtggggcaggtgggcagtggaaacatgggcacagcgaccctgaagtcagttacacggggatgatggggatcagacaaaccctacaggttccccaagggcatttggctcaacctaagtaagagaggataagcttgagggagaaagctgaggtgtctggggagtgtggtcacaattcagggaaaggcaggtgtgggaagtcctccgtgcctcatgaccaccgatggggacacactgagtcaggtgtgggatgagggacagcactgggaggcaggggaggcatgtcctgggatggaggccctgggggcagtctgaagggtgaatgcggacgaggcatccagacagacggtgtgatcaggagccccacagacagaggggaactttgaagctcagagcggtaagcaagtccatcagggcagtgcagagagcatcatgcttgcccttggtggagggtgcgggagagggacttgccccacagaggcgggcagacagaacccctcgagggacagagcaggaaagaggacaaggggtgggggtctcagcaggggcaaggcttcactaaagaataggggaccacggggtgtggagacacactggaatcttgtggaccctctgagcctagggtctgggtggcgcctaacagcaatgaaagggcagagttccaggattgcagatggcaaaacacctgcgtggcagcaagtgggagtcttcactggcctgcccctccttctgtgtggggcactctccacagggcttccagctcatctagatgaggagctccaagccacactccacgactttagacatcaaatcctgcagacaaggggaggtaaggggaccccctgggcctcacggggtaggagtttcccacaaattcccctcattctcagcaccagcttctagaacatagagattacaaataggcatgcacatgcaggtcttggggaaaggaatgacgcttgcttttctgatgtctttgaatggcccagaggagacagaagcagacacaattcactccccatttcataggaaagcaagttctccacctgccttgctttccactgaattctaggaaattgcaccatttctggcaataagtaattgttacttaggtgaatgaataaatggaggagagtctaaaagtgaatttagaaaactgcaattggaagaggaagagaagacacagagagaggcagagatggagagactggggagaatctggtagcagagaccccaggtgagggaggtggcttagagacaaagtggtcagtggcctgacccggactcctctgctctcagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagctttggttccaagaaatatcacatttctgtatttttgtaaatcaaatgaactctgactctgagcccccacttgcctgaagattggaaaattcaatctcaggatgtgctttctttgtttggtaggaggagccacctcctctcctcactatgatgctgcagagggatggggagctacagccaccatttggaagaacatacgggcttcctgagtccacatggtccatttgtgggtgggaataccatgtcttctgtcccctactcagccacctgaatgatttctgcagcccagcagtgatggtggcactcagggctcagtcccaggccttagtgagccatcctagtctcaggtctgcatggaatgggaccacactctcatgacccagggctgcgcaggaatgagacaatgtctccaattgcttgaggaggcagctacatatgtgtcccacctcccacttctccccctataacacctgtgaacactctttctcagtgcatttattgcttttcttgggcggaaggaagctcagaaaaccaatgagaataagaggaaatttttctcagtcttttatgagtgataatttttaatctgatcaccattccatatgtgcttaggacccagcacagaaattattgagccttcttcaaaattaagaaaaaaagcaagtagaagcatgtacagatgtatctcgacttatgatggggtgacatcccaataaacacattgcaggatgagaatatattaagtggaaaatgcatttaatacacctaacctaccaaacatcatagctgagcctggagtaacttaaacatgcccagaaaacttatgttagcctgcagttgggcaaaatcatctaacacaaggctgattttataatgaggtgttgactgtctcatgaaatttatggaatgctggactgaaactgaatgaataattcagttatatgtgtacttgaagtatggcttctactggatttgcattgcttttaagtcattgcaaagtggaaaaattgtaagtcggacagttgtaaatccaggacagtctacattcccaattatatagataaatactttaagcctctgaaaatttgcatctattgagataatcatgtggtttttgtctttagttctgtttatgtgatgaatcacttttattgatttgcgtatgtggaaccaagcttgcatcctagggatgaagtttacttgattgtggtggataagctttttgatgtgtcacttgattcggtttgccagtattttgttaaggatttttgcatcaatgttcatcaagaatattggcctgaagttttcttttttgttgtatctgccaggttttggtatcaaaatgatgctagccttacagaatgagttaaggaggagttgcttcttttcaattttttggaatagttttagtaggaatggtaccaactcttctttgtacctctggtagaattaagctgtgactccatctggtcctgggatttttttggtgggcaggctatttattactgcctcaacttcagaactcattatttgtctattcagggattccatttcttcctgattctttcttgggagggcgtatatgtccaggccatatttatccatttcttctagattttctagtttatgtgcacagaggtgtttatagtattctctgatggttgtttgtatttcgtggggtcagtggtgatatcccccttatcatttctgattgtgtctatttgaatcttctcttttcttctttattagtctagctagtgatctatctattttattatttttttcaaaaatccacctccag

SEQ ID NO: 14353 - DNA, 175236 bp, Human
aaatcagcaaacctccaataaatctattcactgaaaaaattaagacaaatcacaaaaacttttacaaaggagaaaatgtatatgaaagattctgaagtttaaaaagtatgatcttcaactctatacttgattaatgaaggagataaattaccaaaatcaactgaagtgagaaacttgaatgtactaacgactgtggaggaaatgccaataaactgtttgaaaaaaaagcacccccctcctcccaaagggcacagagccggattggtctagggggaggtaccatagaaccggtgctatttaaacctctctggagcatggagaaagaggaagctgagcagccctgaatagcctaggacaagagagacctgccaatcctggactccagctgcagctggctctctgccttatgtagtggttggcctgcggtgaagcccactgttgagaggcatttggactgttgtatggacaggtcatcttgctacgccattctgacccagctgtcaccaccctcacactttttagttatctatcagtggctggtgtcaggcaggtaagcccacaacactcacccaagtcatgctcattaaccctctgactggctgcccttatcccacgatctccactaagttcaagcattttttccccagtatcagaggaggaacactgtttattccagtctacatgcttcaagtagaagtgaggaaaccaaggcccagagaggtgtgtacttacttgcccagtcctcactaggatgaagtcagggttaggactagccccgactgggcgctgggagctaacagctaggggaggaactgcatgacttttgtcctggagaaatgttatggcaggtggacaccagggcacaggcatatacccgaagtgtccagggcagacagggactgctcgtcaccccagatgggacctgctaagggcccaaaaagagactgaaggtgggaaatgtttttgtttttcagtgtgaagcgttgccaaacatatattctaggtttgggaatcctcgggacctttggaagccagattcagcgaagatgctgtaccttttggggatagctctaacacgaggttaacgcaatgctccatgtccctggctgggcttagctgtgagtgcgtcgacctctggactctgtgcaaatggacactctgtaactgacacagctggtaggggttaccgagagagctgggttcctggtctggtggactccgccggatatgcaacgagctctttatggcaccttggagatggttgcttttagtgcagttgacagcgggctcagagcaccaagtgagctagcaccgtatttattagtaaattactccataactctagggctcccagaagaccaaaatcatttgagcagattgcacccagagcaccgcgtggagagagaagaaagcccgccacccacagaccgcttcctcctaccacaggtcccccatcgagttgcatttgttgtccctccctaggcgcatttctgagccttcctttcttaaacatacaccgagcgaaaatgcgccggagggaggcgatgttgcctgtgagccaaagccggttcggcaccaagacagaagcagagagaactgatctctctcccggtacccatgacaatctcagagctagatctatatcgtcccgcgcccagcaagaagcactgtgtgactgtactcccccgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctccccaccgtcttcccggtgtcggcccggggctgggcatcacgcttctgctcttacagagctgacagcctgcaggggagacacggagacagacacgtaaacaaacagtgctagacacacctccacgcacagaggatgacaaataacacagtgggggcgtcagggagagcttcccggaggaggagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattagaagattctcttcttctagccccagttccaggctgaaaggcactgctgtcccctcactcacactctttccatatggaaactgggtgatgctgtttctagctgggggcactgggtggacagtggtgctattcaaggtgttaaggagccctggaggagaggctattcaggtgagggtggagatgatggattcaccactgaacccagggactttgaggggtctttgggacattcacatgtcactggcctgggttggggtgcatatcctgacctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtcttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgtatgatgactcagggaatttagaagctatgtttctgttataaaaatgattgtggcaatggtttcacaactctgtgaatatgctgaaaaccactgaattgtacactttaagagaattgtatggtatgtgaaatatatctcaataaagtgatacgaatatgtctctgtgtctctgggtgtgtgtgtatgtatacatctcagtgctgaaattcttaagtaagttaagcatttcagagtaagacaaagatgataaagtggaccttttacagagaagggatccaggaccatggcaaactgagatagttttctgaaagataagcgaggtaaaattagctataacccggttaactgttccttttttcctgataccttccctatctctgggaaaaaacccctactttacagagaatgaagactcgtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaaattttttttttttctattatactctaagttttagggtacatgtgcacattgtgcaggttagttacatatgtatacatgtgccatgctggggcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatggtgagcatttcttcatgtgttttttggctgcataaatgtcttcttttgagaagtgtctgttcatgtccttcgcccactttttgatggggttctttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctagattttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttgctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtttgcaaacagggacaatttgacttcctcttttcctaattgaataccctttatttccttctcctgcctgattgccctggccagaacttccaacactatgttgaataggagcggtgagagagggcatccctgtcttttgccagttttcaaagggaatgcttccagtttttgcccattcagtatgatattggctgtgggtttgtcatagatagctcttattattttgaaatacgtcccatcaatacctaatttattgagagtttttagcatgaaggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagagcctgttattggtctattcagagattcaacttcttcctggtttagtcttgggagagtgtatgtgtcgaggaatgtatccatttcttctagattttctgatttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcctgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcccggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgagatgtcagtgtgcccctgatggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcccccctcccccagcctcgttgccaccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcagaacccaaatttttcaagtgcatagttaaatattttttctcttgacaagatttttttgatagagctgtttactcttctggtagagatgtagcttgagctattataaataaatacaaatagcatagatatggcattgtggtttcttgttaaacgtggtacctcaccaataaaaatatagcttacaatatttacatttgtgttaccactcactgatttgtatttgtatgcttatttcatagtaatttttcttgacagcatttattgttgaagaaggaagttcagggcacacctatgtgtgttctgacctggaaagtactaatagtcatattctttccatttctggaccttcttgtcttccagggtccttgttctgcatcccataaaagtccagggaccagtttcatctcttctcctcctctccttctctcccaagactaaccatctactgatgacacttgtgggctccatgttaaatttacttctttatgccttttaacttctgtcatgtgactcagcaacacatgccagaggttaaaggacactgcttgtagggcagaaagaaggggagcctctaacacagtgcttttttacaacttttccccctttctcttttaatgcattagccagaaaaatgataaggggtcatgaggggcctggacgtattccctgtaatcactgactatacaggctggccatttaggggtaaatgcttcagagaaggatattctttgtaaatcatgagattctctagggaggcaatgaatgtctcttgtttcactatctcattagagagaaagataaaatgcactttgcacaatccataatgatttatttttttctcttagacgcatcagaaaatatattaaagctaaaacattcttgctccttttcacatagattgcttgataaactaattgataaatccttttttttaaagtcagggtgtgaagatagatgtttaaaatggattgattttgattttttaaaatatcttaaggatataatacaatccatatatttcttaccactgaggactttttgttctataaagtaaatgtaactcatggtatcacttggaatttgatttaaaaatgcatttgaaagcagggatttttttccctattgctttagtttaatttttcagctttattaacaaacggaatgtaaattaatttcccaaagttaagtgtgtgtgtgggtatctcatgtgtatttggggaagctattactggcatgctttgcccagaagatagaactgtcagtaaacaactgacacactgttcggctaaatagtgaacatattctggagaatctttagcagcaaaatgtggacagttagattttgcttttcaacagaaacctgggaaagtgttgagctgaggggagagtctgagagaagtactattgatgagatcagggaggcattgtttccagttctaactattctagttctttgaaatgctttcccaatgggaattccttcccaatttccagggtcatcccaatgtttttaccacacacagcaccagcagccagtggccttcctgagccaggtgttgttccttctgacttccaaatccagtggataatggtgtcttttccccgtccctggctacatcttcctcagacagtaatgctactaagtactttgcctgttcaaatcatccatccgtggtagaggctgctgatatttcaggctggataacttgagtcctccctagtgaatctgatatccgagtcaaatcttctcatccttgtccacctttctttcttctgggccacaaatcaaaactctggagggtcttgtgagctcatatgtagtgcttcagtgcttctccagtgcaacagtggaagacacacctggctagtcacaccattgtgcttccaatcccatctcctctcattttctcagggactttgctcttgttgccatctcttctctgcactattgtttcttctctcctggataaatttcactgtaggacaaagaagggtgtattagtcagggttctctagagggataggactaataggttagatgtatatatgaaagggagtttattaaggagtattgactcacacgatcacaaggtgaagtcccacaataggttatctgcaagctgaggagcaaggaagccagactgagtccccaaacctcaaaagtagggaagctgacagtgcagccttcagtctgggccgaaggcccgagagcccctggcaaaccactggtttaagtccaagagtccaaaagctgaagaacttggagtccaatgttcgagggcaggaagcatccagcacgggagaaagatgaaggccaggagactcggccagtctagtctttccacattcttctgcctggtttattctagctgcgctgtcggctgattagatggtgtccacccagattgagggtgggtctgcctctcccagtccactggctcaaatgttaatctcctttagcaacacccttacagacacacccagaaacagtactttgcattcttcaatccaatcaagttgacactcaacgttagccatcacactagggtttaagaaaatgatggcaggtctaagcgagtcatggagggtttatgaaagatgggtcttggaaagggagttttgtgtataattgggttggctgggattccggaaaggaatttcagaatttagccctggtttcagggatacactgatgcaggaccagagcaacaagattttctcagaatattgatctacgcctagtaaaaacttgcaagaggatttgattttaattctgaaatcgatttctttatactttcaaccttcttctgaactacagctttttcatgttatacagtttctgcctaatttcaaattgaaagtgctgccttcttcatttaaaatgataatttcatttcttgagatagagttttgctcttaaagctttccagagtcatatctcaagagttcagctttttgccacgtctcacgacatacaatttgcaggtcatgcatcattgccttctgctcttcttccttctctccttgaaaaggtacattttctttttaactggagtggtgactctcactctcaactttttcatcagttcctgtggctgtttcccccccacccccagttctcaccctgttattgtgaccttccctttcccctttccctttccctctcccctcccctcccgtcccctcccctccctccctccctccctccctccctccctgcctccctccctcccttccttccttccttccttccttccttgcttccttccttccttccttccttgacagggtcttgctgtgtcacccaggctggagtgcagtcatgtgttcatagctcactgcagccttgacctcctgggctcaaaggatcctctcactttagtgtcctaagtagctgagattaaagacggatgctgccacacctggctttggcttttcttgatgtgtctaaattgttccatgtaaccaggcaatttcatgtgtctttaatttttctaaaagccatgcattccactgctcaaggtactggtttccttgtttacattattcttctataatgtggtatatactcatgaccttcgacacatacttttccagtgtctaattgaattcaaatactgtttcatcaggttcgacttacagtttatctaaatgagattcccaaaggaagaagtactcataccgtaggaggtttttctttgccttttcagtaaatggcctgggaaacagaactttcatgttttattaagaatttatggtgctttgtgctgtctttattagctttttgattatttagaaaaactgcatcatctttaataagtgatgttcatctttaaaaaattatatgtgtgcggatgtgtttatatgaatattctaaaaactacgtaaactgtataagagtctgatggtcttggtatgatgctgtgaatcatgattctggttgttatcttaaaatacggtacacaggccgggtgcggtggcttacacctgtaatcccagcactttgggaggccgtggcaggcagatcccgaggtcaggagatcgagaccagccagaccaacatggtgaaaccccgtctctactaaaatacagaaaattagctgggcgtggtggcgggcacctgtattcccagctactcaggaggctgaggcaggagaatggtgtgaacccgggaggcggagcttgtagtgagccgagatcacgccactgcacttcagcctgggcgacagagcgagactccatctcaaaaaaaaaaaaaagtactgtacacaatagaagtaactaaatttccttgttaattgtttgttacaatgaattctcatcaaatttttaaccacagctattctaaatttttgtcatccacagttttgatttttctcataaagtcatctgcagtcagattcatggaaaagactctaataagtagccttgaatacatgtttctgataacttaaaaatcaatggattaagtacaaatttccaaaagtctaattaaaataactgacatattcatgaaactgctaaccaagatcaaacagagcaacagttaattacatgggactaaactgataatggattataatttttatgacttttatttaaaatattgctaattctttaatattttattttccagatttaaggaaacttttttcttaaggtacctatagcaatttggttatgtatactcttgtgaataatattaaaatgtttgctttttctccctatcttatctctctaaaattaaaaaaaactattcgtgagtattttttattttatgacaatgtatttacataattttgataaaaatttattttttaaataacaagatacaatttaaaatgttaattatattagcaaggtttgacttagacatcatatttaaaaattcttgtaggtacttcggatacaatctgaagcccaccttgatttggccttcttgcttcagaagttaaaaaaaaaagttcaatctgagattcaatcactattctcactgtacttatgtaaatactcaggacaaatctgataaaactaacttattttacatacaaattagtcttgctctgagtactttggtaaaattgggatgacagtgatataccctttattagattgtagtcttgtgagttgttttcaggttttattatatacttgtagaagggactggatcttaaattcttctaggttcctctaatccaattttctcctatggaatttttaaatagaattactaacaatggaaaccattcttttctaaagcgctgtaagctaaaactaaacatcttaatataaattacaagggacaagccttgtgcctgatatgtgggccacacagaaagttcaccaaaccgcctgatgccatagtcagaggcattcagactgcaaaactgctgacttcacactgtggacagtgtttcccaaggccgttggaacaagacatcataatgagattcttaccccttgtaatgcctcccttcttcacttgacaggataatgccataattaaaatttcacaatcagtaacaattatgagtaacttaacaaaagctgatctaagaaatcccttagtccacttattgagtagctttggcaatatccctaacaactttttgttcatattgtactagtgggcccttttacagagttagcactgtctgctttaatttaacccagtcatggaatactacccaatggctatgccaagtcttacccagtttctccatggtcttttgatttgtttagttgattgcccttaggcttggcagaactattgcataaactagatttgtcatactcctgttgtttttactttgtattttccttttaaaaatatgtacctgatgtctgtcaaatttctgcagaaatgcaacttctaatagagtaatgtttgtctagtgtcttaaaatgatagccaacatcaatggaacagacaaaaatcaaacttgatgacatccagacaaacaaagcctgagagcttctccttatggccttcttgttgctcaaatgtggctaaaatggcttgatactgacttccagctgataatcacctgcccctgatgttgtataagaatatctatccaggacaggtccatcctagcacccagggatattcaaaacctgaatacaggctgatcaatctttctccaaagaaagatcttgattaaaagggggaaacgtgaaagttgcagatatgaggataaagtcagttctgtcagactcaaatttgagtcagggaagcatgaaggggaagggctcatgcttgcatatccgagataaggctatctcaaggactttctaaaataactccacaagaaattccttcacagctttcacatatctcattcttttcatgacttaacgttctgcacatatgcatacatttctaggaccaggtttatcattagacattctttagaactgtagcaattcagataagatgctcttgaaagaacccttgcctagtaatggcatctccaccaatgaactgacgctgactctggctttgagcttctggaaaaaatgaactctttccaagcagcttacatgagcttatcctttttgtcaataaaatcttcctcttaccatctcctctttgggtgtatctgtggctttactatagctgtgctatggtgagattacattatagtaaggttatattatagtctgggcagattataatatagtataatttgtgcccagattatagttctttttacttactcttggaaaaatacattaaattaggagataattttctctgatgtcttttttagcttgatgccatcagcatgcagacatcctctctagtatctcctgtcttgaaaaaggaaaggaggaaaacctcctttgatcttaggtccctcttcacccctgtcctatttaaatatttgaggaagttatttgttgtcccatgtctgctttcttttctttctttctttttttttttttttttttgagacagagtcttgctctgtcacccaggctggagtgcagtggcacgatattggctcactgcaacctctgcctcccgggttcaagcgattctccagcctcagcctccctagtagttgagactacagttgtgcgccactggctaattttgtatttttagtagagatggggtttcaccatgttggccaggctggtctcaaactcctgacctcaggtgatccgcccgcctcggcctcccaaagtgctgggattacaggcctgagccaccgcgccaggccctctgctttcttatctattgtcttctcaacctattcaaattggctttcttttcttgtgctctgagaccatgcttgcctaggtcttgagtgacctccacattgtcaaatctcatggtcacttctccatctgagctctcaacagcatttgacccagtggactattctctgcttacaacaccttctgtacttgctcagatttcctctggaatcactagctgttccttcaggtgtcttttaatgggtccttctcatgcccttgactgtaaatcctggaataccccaggccctggcttgggtactttctcttttctaactttgcatgctcccaaggtagcttcctcagctgcagatttacacaaaatctatacattgatttctctctaaattatatttctagcccagatgcttctcctggatacagacacacaaatctaagtgcctgcatcacctctctccttggatatttaaaaaatctcaaatttaagatgttcaaatgtgaactcttaattatctctaccccaaactgtttttctacttgtgatctcttaagcaaaacaaaacaaaccaaagtaaaacaaaaaccaggactcatccttgacatttctttcccttattcccaattcatcagcaagcctttcctcttggttctactttcaaaatacaaccgtttgcttttctccatctctgctactatcaccttggtcctggccatcatttcttgcccccatgattgtagtagcctcctaaccaatttccagaccagctacaattcatttgcccacaatggccaggatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacagcaataaaaacagctcatgtgggaaaaaaaaaagaactttaggaggccaaggagggcgaatcacctgaggtcaggagttggagaccagcctggccaacgtggtgaaaccccgtctctactaaacataaaaaaattagctgggcatggtggtgtgtgtctgtaatctcagctactccagaggctgaggtaggagactgtcttgaacccaggaggcagaggttgcagtgagccaagattgcaccactgcactccagcctgggtgacagagcaagactctgtctcaaaataaataaataaataaaaaagtaaaaaataaaaacatgtatctcagaccatgtcattcttctgcttgcatgtcttcagtggcttccagttgaatttaaaataaaacctaagcttcctcttcgggcctgtgaaacctcacttgacttggcctctcccactcctctcctgaggatgtttagccgctttttgctcccttggtattctaagaaaggtcattctatcttggggcctttgtggtagctgttcccttagcctagcatgcttttccccttgatccttgcaaagtagttccttcttgtcattcacatcatagcacagattaaggtctccttttaagagagggcttccctggctattcaattcaaatagacatttaccctttcttgtctgttatccagttgggtggattattttttcctatcacaaatattttaatattttcgatattttgataattgtttttcaatataattgtgttcctttattctatgtgcttttaattaaacattttattttgaggtaattgcagattcacatgcaattataagaaataataccaatctcttgtatcctttattcagtttcccccagtgataacactatgaaaaactattgtacatatcacaactaggatgtttatgttgatacagtcaggatatagaacaggtccactaccacaaagatcccctgtgtcaccctttatagccatacccacttccttcctgcctccattccctccttaacccctggcaactactatttttttcttcatttctataattttgtcattgcaggaatattatataaatggaatcatacagtctgtgaccttttctgaatggcttaaagtgtcagcgtaatactatattcacccaggttgttgtgtatatcaatagtttgttcctttttattgctgagtagtaatccatggtatggatgtatcacagtttgttcaaccattaacatgtggaaggactttgggattgcttccagtttggggttattatgaataaagctgctataaatatttatgcacagattttcctgtgaatgtaagtgtgtgtttctctggcataaatgtccaggagtgcaattgttagaatatatatatatatatggggaaaggcatgctaggctaagggaacagcaatcacaaaggccccaagatggaaacacccacccaactggagatatatgtatataaaatctaacattgtactcctggacatttatcccagaggaaaggtactactttgcaggtatcaaggggaaaggcatgctacgctgaatctgtttaggtttttaagaaactatcaacctcttttccagagtggctgtaccatattacattcccaagagttatgtgtgacagtttcaatttctccacatcctctccaccatttattgtcattctttttaattttagcctttctgttagatgtggagggatatgtcattgtggttttaatttgcgtttccctaattgcttgtgatgttgaatagctttgcatatgcttattggctttaagtatctcctcttatggaaaatgtctgttcatatctttagcctgttttctaattgggtttttaaaaaactgttgagttgtgaattctttatatattatagatattagtcctctgttggatatgtgtttgcaaatgttttctaccagtttgtagcttgtcttttcatcctcttgaatcagatcttttacagagcaaaagttttacattttgatgaagtccaatttaagaatttctccacatatggatcatacttttggagtctaagaactcttgcttagtcagagatcatgaagattttctcctatgtctatttctgaaagttatatagttttatgttttacattttagtctgtaatccattttgaattaatttttttaataaagtgtgagacttaggttgttttctttgcctgtggatgtctacttactccagtaccacgtgttgcaaaggctatccctcctccgttgaattgcttttgcatctttgtcaaaatcaactgagcatatttgtgtgggtctactcatgccttgcctattctgttccattgacctgtatatctgtcccttggccagtactatccagtcttgatgactgtagctatattctaagtcttgtatcaggtagactgacttgtcccacattattctttttcagaattgttttagctattctagttattttgtcttttcgtataaattttagaatactcttgtctatataaaaaaatcttgctggagttttgataggaattgcgttaaacctgtatatccatttggaaagcattgatgaacattgatatgtttcctgttgtaagtcttctaatcaatggatatggtgtatctctgtgtgtattttgctctttgatttctctcatcagcattttgtagttgtcagcacatagatcgtgtgcatgttttattaaatttgtagctaagtattcatgccttttttttagtgattgtaaaaggtattgtattttcttttctttttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttcttttatatttttagtagagacagggtttcaccatgttagccaggatggtctcgatctcctgaccttgtgatctgcccgccttggcctcccaaagtgctgggattacaggcatgagccactgcgccctgccaggtattgtatattcaatgtaggtgtccatgtatttattgctagtgtatgaagatataattgtttttgtacgtttatcttgtatcctgtgaccttgcagaacttatttattagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtgagttttattagtttgtgtttttcaaggaattggttcatttcaattaagtgatcagttttaggcatgagagttatttatagtattcccttattattgttttgttgtctgcagggctatagtaatatctcatctttcattcctgataatggtaatttttgtcttctctttttctttttcagtcctggtaaaggtttgtcagttttattgatcttttcaaagaactagccctttgttttattttctcaattgttttgttcttttcaatttcgttgatttctgcccttatccttattattttcttccttctgcttccttagtttatttgcatattttccttccacaccaggttcttgagggaaatgagattattgatttgagaccttttctgtcttctaaggtacaaagttagtgctatattctttccttttatctcacttcagttgtgcctcactaattgtgatatgttgtagtttaattttcattcaattcaatgtatttttgacttcccttcagactttttctttgatccatgtatcatttagaagtttgtttttttagtttccaagtgtttgggatttttcttgttattgatttctactttgatttcattgtcattatagaacactttctgtatgatttcagttcttttaaatttgttgaggtttatctgatggctcaggatatggtctatcttggtatatgttctgtgggtacattaaaacgatgtgtatctgctgttgttgagtggagtgttccaaataaattatctaaatattgattagctctttttggttgatagtgttactgagttcttctatatccttactgattttctgtctagttctattaattgttgagataagtctccaactataattatggatttgtctcccttctttcattgctaccagttttgctttacataatttgcagctctgctgtttggtgcctacacatttaggattgctatgtctacttggtgcactcactcttttactatcatataatgttcctgtctctgataattttctttcctctgaagtctactttatctgatattaatatagccagtcctactttctttttcttttctcctgttttctttggattaatgctcgcataatatatacattttttgactttcaacctgcctatattgctatatttgaagttttttgtttatttgtttttttgagatggagtctcactctgtcacccaggctggagcacagcggcgtgatctcagctcactgcaacctctgcctcctgggttcaagtgattctcctgcctcagcctcccaagtagctgggattacaggcatgcgccaccacgtctggctaatttttgtatttttagtagagatagggttttgccacgttggccaggggttggtctccaactcctgacctcaagttatctgcccaccttggcctctcaaagtgctgggattacagacatgagccactgagcctggcctgaagtttgttttttatagacagcatatagttaggttatgctttttaatctactctacctgtcttccttttaactggtgcatgtagaccacttacatttaatgtaattacttatatgttagcgctaaaggctgccattttattttgggggtatttgtttgttactctgtttttaatttattttcttttctttcctgtattcctgtgtgttaggtgaaattttttagtattccattttggtttatatagtgtttttgagtacacctctttgtactgcagttgtcgtggctgttcacatgtgtgtgtatacatacacacacacgttatcaaagtctactgatgtcatcattttaccagttcaagtgaagtgtagaaaactaacctccctttgtcttccattggccttccctatttataatataatttcattaaatatttcttctatatacatttagaaacacattagacagtattatagttgggctttaaccatcaaatatagtttagaatacttatggaaaggagtctattatgtttacccatatttttgcttatcatgtacttttttcttttctgatgttccaagattctgttttttattgtttcttttagtttagagaactttctttagcccttcttttagggttggtctgctggtaacaaattctcttagttttccttcatctgaggatatcttgatttctccttcatttctgaggatatttactttggatataagattctgggttgatggttcttttctttaagcaactgaaaaatattctgccactttctcctggcttttgtaaggttaaattaaataagcaggaggttattaccttgaggctgttttcattctttgagtttctacctaatgaaccacaaccaaacagtatgtaaacaaattaaaagctaacttagaactataacaaacagccaagtttcagccagtcacaggcagctagctgatcagactatgcccaaataaggcaaatacctcatcataccaggctttaataaagcagatgcctagctgtagccaatccagtgatttcatgactttgcttctgtgtctggcctataaaagttcacttctcatactaccggacacaggtctctgaacctcttctggttctgagtgctgcctgattcatgaattgccctttgctcaaataaacttgattaaatttgtctacagtgtttcatttaacagtgatttctggtgagaaatctgctgtaattcaaattgtttttctctataggttaagtgtcatttctctcactggtttcaagatattttttctttgtctttagattttagaagcttgactatgatgtgtcttggtgtggatttcttttcttttcttttttttttgagacagagtctcgctcttgtcactcaggctggagtgcagtggtgccatctcagctcactgcaacctctgcctctcaggttcaagtgattctcctgcctcagcctcctgagtagctgggattacaggtgcccaccaccacacctggctaatttttgtacttttagtagagatggggtttcgccatgttggccaggctcatctcgaactcctgacctcaggtgatccgcctgcctcagcctcccaaagtgctgggattacaggcgtgagccactgtgcccggctggatttcttgctttatcctgtttggcatttacttagcttcttggatctgtaggctgtcttttgccaaatttggaaagttttcaaccactgtttctttgagtgctttaccagtcctgccttcttttcccttctcttattggaacgctgatgacatgaatgttaggtcctttgttatggtccctcatgtccctgcagctttgttctttgtcttatttttttcctgcagtttattttctctctgttgttcagattgggtaattttcattgttctatcttccagttcacattttttttctctgtttctgcattctgtgggtgagatataggctaatttttaatttcagttattttatttttcagttctaaaatttccatttagctcttcttcatatgttccatttctttgctaagactttctatttttcactgcttctagcatcttcacagtggcttcttggcttctttagaatctttgtcagataattttaatggttctgtgatcttggtgttggcatctactgattgtcttttctcattcaactagaaatcttcctgggtcttggcatgattattgttttattaaaatctgggcatttggggctatgatattatgagactctggatcttaattacattgtctggttttgcttgttttctttgacattgctctggtaggggacatggggggcactgccttgttacttccaggtgggggaagtctcctctcagacttcactgacactcaaggtggggtctcattattgctgagggggagcgagagttccggccattaggcctccactgataacaaagcactcctacccttctctggttgggaggggtatgagtgccttgttactgctctgcacttggcctcaactgacaccatggcgggggcagcctcattaccaccaggtagttctgactctccactaggcatcctctgacatcaccccagtggggaggagcaagggcacctcatttctgctgatggaggcgaaagttcaggctccccacatgctgtccactaccaccaaaggtgggtgggggggtgggtgggtgttgttactgccttatgggtctacttggccttctctgacactgccccaggggtgaggaggggagagggctattggttacctcatttcagcctggcaagggtagaagtctaggcccccattcatcctttgctggtgtggataagggtacggccacattttgttttctctgtggtctgtggctggagtagagcagttattgtctaaaagttttctttcttccttggctgccccttgcttggtcccttggctagagagagcagacatttgcttggtcccttggctagagagagcagacatttgttggggcttttttttttttctgagacagagtctcgctctgtcgcccaggttggagtgcagtggcacgatcttggctcaccacaagctccgccttctgggttcacgccattctcctgcctcagcctcccgagtagctgggacgacaggcacccgccaccacgtccggctaattttttgtatttttagtagagacggggtttcaccgtgttagccaggatggtctcgatctcctgacctcgtgatctgcccgcctgggcctcccaaagtgctgggattacagacgtgagccaccgcgcccggcctgttggggcttttttttttttttatgtccatgcgcatttccgtgttgctggcttcttcagctccaaatcttggacacgtgagggaaaaagaaaactgagagaacccatgaccttgtcctttcttgggtcccagggtcccaagctggtgtgccttcttctctccacctttcagagtcttcttatgtttgtgttctatataatgcccggggttttaaattgtagttagtgtgaggaatagagaaaagtatatctaccccatcatccctgaagcagaagtcctctgtgctacccaattttaaatcccttcttagcggatgttactgtctgataatctcttgtcctgtttatccctatggtatcccaagtccctcaaacactgcctggcacatagtagttgtgtagtaattatatgctaaatgtcgaatgaacattcagcaggtagcgatgatggtgaattggggcctgaatgtcctgcttctgtttaccttcagcctgttctttgcctagatcctcttgatttttttggagggaggatgctaaaaatccagattttatatgaaatgtcctacttttgaaatattggcaattaatttaattttttaaaaagctgtgcaggccaaagaaatgtgtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccgttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcggggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaataaaataaaataaaaaataaaaagttaactagcattcctgaattttacccatcctggatctctgctattcacattggtgtcaccaagtgcattttccaagaaaagacagtcattgcctaaaacaaattgtcacctgttgtattgaaattattttggttacttcctgtgcctgtctaccagatactgcttatacaagtcttgaggaatgcttgctgagtgaatgaatgcttgcattcttttctcatgacttcgcacttacagcgcacagaaatctgaggtctgtagactcctggttgctgaagagttgggatgttgcaccaaaattaaaattttctttattgtattagtctttgactttaactctggcatctactttgtttggagctttgtcttttataaataaataattaggagtaaggatttctaaacattttatcttcatatccaggacaaatgttttgcagttagttaatcaaccattacgtgagtattgatcataatactaattagatttattttgcagatgtggtggatgctatacaaagtgttttagtggaaaggtctcatttaatcctcataactatcaaaaaatagtataaacagtcaaatagtatgtcaaatagtataactagcaaaaagtagattaaaatagtattatttttatcctccttctacgaaggagggaattgaggcttggcaaggtcaagtaaaatttgctgaagtttatacagttggaaagtgatctttccaggactcaagagcaggcttgtgtgattccaaggcaagtacagtacagtatttgttaccatcgcatgagataaatatttgtgtttgtatttgtcaccattgcatgaaataaatctgttgctaattctctaaccttttctccatgattctgaatccttatataaatttgaggtgctttcatcattcattggagccagatgtcacctgtttacactctgtattacatagaatattctaaaacaggggttggcaaacatttggcctgtgggccagatatggcccactgcctgttttattgtacagcttgtgagctaagaatggtttttataatttcttctaatggttgaaaaaaatcaaaagaataaaaatatttaaaacatgtgataattacatgaaattcagatttcagtgttcatacataaagttctattggaacacagccatgctcatttacctacttgttgtctctggctgcttttgtattacaagggcagagttgagtagttgtaacaagagactgcatggagggcaaagcctgaaatactactatgtggtccctacaaagaagtttgccaacagtttttctggactataagtctgggcaattgaagtatggcggtatgcatgtttctgaagccctggatagaacactagaagcgttttgtctgaatatgcagtttggttgtgcatttttggaggatccccaatgctcaacagttctttttcatcctggtgacctggggagggcctcactctggaatacattcttactttgtagttcaggagctacaagtaccaaaaagtcacctctgctaatgccttacttggccatcacacaccaaactcttctatccagatattatagtactggggaagaatgactgtggtatgtttgcttggatggggactctcatttacttggagggaggaactcaagaagcatttttgggttgcaggttgtctggcattttgctgtgcatttcattgtaatttctcaccagggaaacactgcttgctctcctggctgggtttacttcatttctatcatcttttctttcttgttttaataattccaacttcatcttgccttctcctttgcttcattttgaaagagtcccagtttgcttttcttgccaattctctacttacttttcccagagctcaaaaattattcttgggggtgatgtcattttcatgtttatctttcttctctcacatgacttaatcaaataagtatgtagattataatttgtgagctgtgttctgagggaattaattgatcatcatcatattcttttaaaaggactgtggccagttttagcctcggttaacttcagtcagtttgtacaatagtaatggaatgttttggcgtctattggagcaggcgtggaccatatatgttctataggcttttcagaaattctatgcagaaattatgtgaaccagatggtacccttttgatttgccagacatgcatacttaaagaaatgtggggcatttattctccttaggagacttagagggggttctttgggaatgtaaatcagccaaaattgtcctaattgaaaaattctttggagtttgtcatcaaaataaggagtgtactatcagaagaccgcatagattttgcgggaacaaatattactggatttatttgatttacttctctgagaatgaaaagccccatagacttaggtaaaagaggatataatccatgagatgcttttattttgatagggccatggatttgctcacttaggcctctttggggacactttcagcagtgagagtatgtggatgtgaggtgggtgagggagatggcatgggtcccagggaatgaacagacagtgagggccagttcattaaaccgaaagctgaagggacagggtctagtcattctgagaagaccagactttaggggaacttgcagatcattgcaggggcttaacctacgggagggcaactgttagatttcctctgagcaggtagaaggtgtacatgagtcatagttacatctaagcacagagatttgggattcagcaaggattgcagaggaggagatagtgtctttcttcaggtaatatgaagagcacagtggaactggaagccccagccagatagggagagctgagtctggttggctgtctgcactggcacttgctggggactttggggaaatgtctttcagtgcttcagtttccttatctgcaaattggagttaatacctcaaagggctgatgggtttgtgccgcttacaaattatttggctcaattctaacttgtaatgttgtgctgaagcttagaaattatgtatctcaagtgctttatatatgatatatggtttaattaatgggagctttagtatagtaatcatttagtatactggttaagagttgagttcagaatcagagagacctggctggagtcgcagctcagccattttggtagctgtgtgatggtgaacgagtcacatatcctatgtaagcctcactctcctcttccgtatactagggtaaagagcagctccaacacggtggactcaactttggggattaaatgagctaatgcacatgaggtgctcagcacagggcttggcccataataaacgtgtaataaatgctagctgataactttctccactgacctcctgcctggaacagaaaatgaaattctgcttcttaaaaccaaatgttataagcttcatccttataaaccaactgcctttagaaatgtcctctttctactcttctctgggttcctggggagcagaacgcctgcttgggtgatgacttatgtctctcaaatcctctctacccctccatgatatcacacatttccgtcgtacggcatgtactaaggtctgcacttaatttatgatgtaagggccaggtgcgtattttcagccttcaaaggctgagtatatttgggattgactctgaagggggaatcccctgttgtttcattcatacagtaggtatagcctgatggttagagtgtgggttagtatatctgggctgcgtagcttgctttcttggttggcactccactgtaagcagacctcgatttgtgtagaggtagagcgtgtgcatgtgtgtgtgtgtgtgtgtggtgttgatgttgttgttcttgcagtgatcccgggaaaactagctggtgagtagggagagtgacggggaggagatggaagccaatcaaggtgcactattaatcaagttagttaccatggatggtaactggagctcattcttcctagggaactctcacagacagcatagaagccacctgagagttatcccagcaaaggcaggaagctgggggatttatctaccaactgccctgcccatcattggctgaggactgtttctgggacgttaagtccctggcacttccaatttgcctggcacatgggctaatgttcctttggttgggggtaaaaaggcctccagactgaaggttgcaggtgtttgtggtaacagacttgatcttgtagaattgagtcctcggggccatcagtggggcactgacagcatctgctctcctgtctaaggtggaaggctgtctctgccacctaccagctctgtgatcttggccacactacttattatgcctgagtttcctcatctgtaaaatgaagataataataatacctccttcccagacttgtgatgggaatgaattgaactgatatgtgtaaggcacttggtagaatgcttgccatgtcgtaattgctaaataaatgctaacttttattattttgtgattattcattgagtttcttcaggttctttttcagtgtaataaaattcaccatgtttactgtgacataagatgaagattttttggatggaaactaattagttgtttctttgggcatcagattatttccccaatttttatttatttgaaaactgttacaacaaaaacgcaatctgttttagggttaaaaaaatcctctttaactctatcacccttcaattattacttttatctttttgttcctttggagtctgttgatataaattcatatttctacactgttataataaataatggcaaaactcagtttttatcactgtttgttctaaaaataaaatagcaaccctgtacccagcatactttacaggttttttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcctcccctctgctctgtgtctctcacggtggctgaggtagaatacagcttggaagttcagccagcccttagtatccatgggttccacatttgtggagtcaaccaaaagaaggtcagaaaaatttgagaaaaacaccaaaacatctggattgaacatgtgcagactttttcttgtcatcattccctaaacaatacagaataacaactatttatttagcatttacattatattagctattataagtaatctggagacaatttaaagtgctgtatatgcaaaaatgtgcatagattatatgcaaatatgactccattttacatcagaggcttgaccattcaaggatttgtgtatcccatgggagtcctggaaccattcccccatggataccgaggggtagctgtacatttattggtgcctgccttcttgcctggtgcctgtttgttctttttggattaagagaaataattcctggctgtgcacagtggctcacacctgtaatcccagcactttgggaggccgaggcgggcggatcacctgaggttaggagttcgagaccaggctggccaacatggcgaaacttcctctctactgaaaatacaaaaattagcgggcgtggtggcagccacctatattcccagctagtcgggaggctgaagcaggagaatcgcttgaacccgggaggcggaggtttctgtgagccgagatcctctcactgcactccagcctgggggatagagagacattctgtctcaaaaaaaaaaaaaaaaagagaaataattcctgtcacagggagcggaaacatgctgaaataattatttgctgaaattgttttccaacagatggctttaggaatcaggagatttgacactaggacgttaggtgggcaatggatttctagtaatttgtcagctttgttttattgaggtggagctgcatttaaattgctacttctccctgctggtttggtttggttctcctcagaaatggcttactttatttgtacttgacttgagttacattaaagcaggcaaaaatatttcttaagagctgaaatttcaggttggcaaaaggaaacaatgcaatctttaatcatatatctgaaagagcacagtggtgcattatgatggcagaacttcattccctaaccctgtacaaaggtttttagagactaaaggattgatcgtttttttcccctgacaaaacacctcttttgacatgtgcagagaaatatgtaatttgggttgcattgaaagaaagctactcttgctatttctctctccaagaggctgtgctcttggagttaatattttctactggagacagttctacttgaaaggcaaatattacaaaaaaccactagagaggcattgaaatctgttgtgggaaggagtcattttaaattttcttattaaaagaagatggcactaaagaggggggagtcatttccaatttattacttaacagaaagatgagcaatttgtcctctcagcaatagtgttctgtcagataacctgtttgccatttccttgccaacactgggtcttgccattcatttgaaatgtttgctcttgtgatctattaaaaaatttgtatatattgattttacatatgtgctgatcatttgcatttcttttgtgaattgccttttgatattttccatttttaaattgtcattttcaaatttacctttatatatgaaatatattaatccatcatcatatatcttgtaatggtttatttagctgatcctttgtggttgttgcaagcttttttgtgtattgttttacagtttgcagtttttgtcacaaattaaatccattttttgggatataaagtaggctttactttttatatattctgttcttttctataccggtggaaatcttgttattaatgtatactgcctccttagggtttgttttccaaatctcttttctttctacaagcatattagtctgttgagccttcttaagttttttttcttttgattcaaagtgtcgctcttgttgcccaggctggagtgcaatggcgtgatctcggctcactgcagcctccacctcccaggttcaagcgattctcctgcctcagcctccggagtagctgggattacaggcgcgcaccaccacacccggctaactttttgtatttttagtagaggcgagttttcatcatggccagggtggtcttgaactcctaacctcaggtgatccgcccacctcagcttcccagagtgctggaattacaagcatgaggcaccgcgctcggctgagccttcttaagttttgagagaattttcttaagtttgttttctaagtctctcatttggtttcctttgatacgcaagctagtttttctatgctataccatttttaatgtgaacagttccgttctaggaatagaaatcttgatctcaatttgtccttcttccagggggcaatgccatcaagaatccaacctggaaatcagaatcagtgcactgttttgacttttccttcccttgccttctgtgagtttgtttcttatggtcatacttactttgatttctccaattggttctcttattttaaatgactgagtttcttcatatgttggattattttctcctatgctcttcaaagaaagtggctctagtgtgtctagtttcagcaggtgagatatagtctgttgtcagcccagacagggtgagaagggagagcttcagattgatagtttagctttctgaaaggaaggttgcaaatggagggccttgctctagaccagtgcggcccagtgcaaactttctgtgctgatggaaatgttcttggatctgagctgcctggtatgatagccactcaccatgcatgactactgagcatttgaaatgtggctagtgcaagtgagatggatttctaaacttttatttacttttaattaatttttattaattaattaaaacataaatttaaatgaccacatgtggccagtggctatgtattagatagcacggtcatcatgaggacggcttcctgtgtgatttgtttactgttgtgttcccagccccagtacttgtcacacagtagacactcaatattcatagaaattaatggatgcagcaaggggaaatctctggtagggcttctttccttgctatgccaagagttccttttctttctgtgggtctgcccaaagttagagaagtcgcattaccctcatcagtaactaccacaagtgctgttggtaggggcatctgtaggattcccatccccatggccctttttatgtcctactgtgtgtgccagtctgaccagtgagatcaatccatccttgccttaggaattcctaagaatttcagaaatttctcaaagctgctgccaggaagttgggagttgtcctagtttgtaaagctgatctagatacttctcagttttatagtcctatggccattccagggagaatgttggtgctagagagaaaagaactgagatctgtgttttgaatcaagagcctattgtcatctttctgtgttttaatggcttactatatcttgatgcaaaagcttcagtgtttacgaggctccactactgattgtatctttcagcaatctcaaatgaccctctttaatcccattttctgccttcttcttatactcagaatgatacaaatattacccccaatttaattttttcctcacatttgccctcatcttttggtgtaatactatggtgttactttaaagggtttttaagaagcaggtaatttatgtttgaaccaattttgattgtctttgcctattatttattgaggaaatcgtactattgacacagtggtatgtctggtcatctgccatttcgttttccttgttttttgctttcagtcctgtctttacattatcattacatttacttttatcttgtacttttgtttggatcatagttatgccatttctaattctagtagtggatcctattaagtttttaaaaaatccatattaaatctatatttatgaaattgctgaagtcagtaaaaatagttttttttttcactctccctgatagacaatcccacatttctttattttggttgtttttttgtatctcttttcttttcttctatttcctgagacatttggcaatctaatctagaactattcaagtcagcatttcacaaataacctcagtgattttcttttgtgtctctcttcataatcctgttatgaattatgcatgcatttatattaaacttagttgatgctcactttgccattttgagttcttaggttttccagctctctctgacatgaagcacattttcaaatacgttcttcaagaagcatacaccatatgttttctgagactttgcatatttaaaacattttttttggttgccttctgttgcgaacaacaatgtgtcttaatttagtagttttaaagtcacaagtgtttaaatattaaaatgtagatattgatgcattatcttccaaaacctcctgttgggggtaaatattgaggccatcctgatttgtattcccttgcagataatctctctgtctcctattttctcacctttgaattctgatgactctttatgtgtccttgagactaaaaaatgtcaccagaacatgtctatcagtgaatctctttccattaattttgcttaatatatgatgaaccatgcaaactgaaatctgttttcaactgaggaaagtgtttttttctggtaagtgcttatttattgtttggatactatttgtgtgggttttattttgggatgaaatagttttacatgggttggatgtttcttctgtgttccttcatatattaatgtaggtgcctcaacaagtctggggaagaataatgaaaaagtgttgtgttctttgcgatgatttttgtttttaggtaattttttgctccatttttgaagtatttctcctctttttccattggctgcattttttagcattgtaaagtgtgtgaagtttatttattcatttatttttttgaggtggggtcttgctctgttgcccaggctagagtacagcagcatgatcatggctccctgcagcatccaccttccaggctcaagcaatcctcctgcctcagcctcccaagtcgctggaactacaggcgtatgccaccacacctagctagtttggtttttgttggcattttttttttatagagtcagggtctccctatgttgtccaggctggtctcgaactcctgggctcaagccatcctcccgccttggcctcccagagtgctgagattacaggcatgagccaccatgcctggccggaagtttactttttactgcctaccatgtggatttgtttttttaaatttctattatgaggaattttatacatacagaaaactaaagagaaaaatactatgaatacctctaccccatcacatagattaacaggtattaacattttgccatctttggtttatcttgttttattcctgaagcattttaacagaccacgtaacatttcattcccaatacttcagtatgcacatctgaaaaataagggcctttctcttaggcctttctctaaccatgctaccactatcacatctaacaatgattttttatgtcctccaatgcccagcctatattcaaatttctctaatattctccaaatgtcttttatggccagcctgtatgaatctggatctaaccaaagaccatacattgtatttgatagttatgtctcttatactgcttttttttaaattcaaatttacataacataaagttagccattttaagatgaataattcagtggcatttagtagtcacagtgttgtacaatgatcatctctatctagttccaaaacattttcatcaccccaaagtaaaacctcataccctttaagcagttactcctcatttcccaccccacccatctcctgggaatcactaattatcctctgcctctgtggatttacttattctggatattttatatgaatggaattgtacaatatgtgaccttttgtgttttgcttcttttacttagcacagtgtttttgatattcatccatattgtagcatgtatcagtactttattccttttcatggctgtataatattccattgtataaatataccataatttgtctattcatttatcctttgtggacatttgggtttttctcccttttggttattgggaatagtgttgcaatgaatacttaccctagtcagctcagactgctataacaaaatactggaaactgggtggcttaaataacagatgtttatttttcagttatggaggctgggaagtccaagatcaaggcactggaaaatttggctcttggaaagggcccgcttcctggcttgcagatggctaccttctccctgtgtcttcacatggcagagagagagagagagagcactctggcctctcttcctcttctttataagcacaccggccccatcatggggtccctacacttgtccctcttctaaacctgataacctccccaaagccctgcttccaaatacaaccacattaggagttagagcttcaacaaatgaatttgggaggacataaacattcagtccatacaatactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaattttcttttctttttcttttctttttttttttttcctgagacggagtcttgctctgtcgcctggctggagtgcagtggcgcgatctcagctcactgcaaccttcgcctcctgggttcaagtgattcccctgcctcagcctcccgagtagctgggattacaggcacatgccaccaagcccgtctaatttttttttgtattttagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggtgaggaggttgcatgcctcagaatgcagttagcctgggcatctgtgcaccaggctgagttcttgcctaggagctgcagatgtgtgatgaatgcagaactaaagttattgaggagaccaagagacttgacctgggagtgcttatgtggtttggatgggattccttgaggcttttgtggaggagcagtccgtggagtcagggtgtccgtgggtcactgttagcccacatggtgctctttgtatgagttagaaaaatacgcctcttcctcgacacactttactttcatgcgggggaaaactctcctatcctgaattggttagagctggtgatttgacagccgcctgctggaaaattgtatgataagtacacaaatctgcttcaggagggtgtgctcccttccatgtggcacagttgtcaccccctgcccagctgcctctgcagccactttgggttttgtggctgatgttcactagccactgactatacatctgaatctcttcctgtcagtagaagatccttctgatttgggcatatggtcaactttttatttttcataactcttgctacccctttcctccatttttattagttttcatggggacttaagtgagcatccaggcaccgttgctgatctgtctccctgacccagaagaccatgttggcttttggacaaagatcctggatagttctgaagctatgatgctgtgcatcagggttgaatgggggtcctgagagtccagcattgcttgtgctagcagctcatagcagcttaacttgtgtagcagaatgggtgccttgtaatagatagccatctgcttttcagtttatggaaggcttcgtttcttctgacggcattctgacgggcaggtgttacatcttttgtgactcccaggttatgaggctggttcttgggtttgactctgggaatcatgctcattgatctgcttttcctaatcatgtcagtgaatacctacacgtgaagaaaactcaagctgcaccataaagctaaaggaagaaggtaaaaaccacctcaaatttccgtgatacaggaaaaactgctgtgaccctccacttctccatcctggtcccatttcctgtttccaccctcatccagtttgcttttccagaatctttactgcttcctttgatgggggtaacgactctccctaaccaccccacctcccgtgggaactgttaccccatccatagccagcatttgacagcccaagggcaggtttatgtatttgcaaacgacattattctcctataactaaaaatgtaaagatcctttcgtattaaatagtccagtgtccctagggcacagtgcttttggatttcagcctgcttctgctttgtgatcttgggaaagtcactaacccctctgggcctctatctctatttaaaaggaagaggctgaaccaaaatgccctttccaggtgaaagcaagtggggaagttagacctatttagggaatagagaacagcctgtgggacaggtttgtgcttattgttggtgcagtttagtaggaattgtcagaagccgatagatagatagatagatagatagatagatagatagatagatagatagataatagatagatagataatagatagatgattgatagatgatagatagatgacagatagatgatagattataaattgatgtttgatagatcaatagatagataaaagggaaccaaatactgtctctgtggcctgggcatttttgccaggcagggggaatcacatcgttggtgacagagttgtatggcccacagaggccagctaagagattgggagaaggttgttgaccttgtgtgggaaccaacctcagggggatggatgaggttggggccccttaggggtctccgctcttggcgtctggactccccttctctgtgggtctaagctggcttctttctgctgtgggattgtgttaacactgcccctttagtgattttgcgttttttttttttttttttccgctgaccctcattagcagaggttttgctcttacacactgcattgtcccagtgacttcttatatgccagtcactggtgggtaaatgccagagggacactgagggctcatcaggaggactcagcctcctctcagagaggaagccaaggtggccagattacaatttgttttttctggtaaatgtcatgggtaggaaatgttatttgtgagtctgaaatatccaccaagggcagagggtgctctgaagacaaacaggaattgagtgctcattttcttggccctgaagtgatgtgttgcctccgtgatgtcacagttggcccccctacaacctagttcagcctggcacagtatatgacggtggtcactggctttctatctgggcaggatagcacctgcacatcagggaaaacagaccaagctctcacaagggcaatatcatcctttggaatttgttcacttttaattacaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacaggtaataaatgggaaaatgttaagggggagtggttggggaagaacagtaaacttggaaaagccattctcatcagcacagaagcactgaaagaaggtacagatcttcatggtgaaaagtgggaagccttgtattagcaaggagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggagatcaagaccatcctggccaacatggtgaaaccccgtctctactaaaaatacaaaaattagctgggtgtggtggcatgcgcctgtaatcccagctacttgggaggctgaggcaggagaattgcttgaacctgggaatcggaggttgcagtgagccaagatcgccactgtactgcagcctggtgacagagcaagactccctctcaaaaaaaaaaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctcccagataaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttaaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaattaaatgatcctcttcccagccatgttaccgtgacacatcggctctgtcttggggatcagtggctcagcaagtgagtccttagtgtctcagttcatggccctcctccatgctggtggccttcacctcctccattgcatccatccatcccgtagccagactggagcctttggcatcacccagacctgcttttacctgagttcttaaattccatcctgtgagctcctgccctgagcgattcctctggttctattgcagcaactttccaatctgtaacccgccatgcaatcataacccacgtggtctcgactgttaagtaccagaactgctgggcgggagggagggtgagcctggagacagaggtcaggccaggttgtgggccttctcctgtaaagagtcttcagcaattctagtgggatatccaagaggttgttgtgactttggccttggccaaacaccccaggggtgttataattggggggtgggcagccactgggagaggaagtgccaccatggctgtaagtggaagaatagaaacttcaatcgggagggatccagtacaggaagagttcagttctcagggagagagggttggagaaagcctgagtcgttgttagggcattagccaaatggccaggacttttccagagggaagctgggatataatcaggaaactagggcaggaggctaattctgcatactggatgcatgggccaggttcaggtgggtctcctgcccaaggcttgccacaggtatgccaggctttgggtggcaggaggaatggcagagctcagccactggagggaatgagcctgtgcccatggggctagtttctgatgggctcggtcactggaacaggttgggtgagggtggccatggagaacctgcaggctgaagatcttttatatttggcttatttattgagaggtctcagctctgcacatacataggaattggttttatttttgctaatcactgctttccactgtgctgaagcaagttcttctctccttctgtggagtaggactcttgaggatcctttgaccagggccatatatttcctgtcatggttaagttttaaaacctttttatttctgtatgacttagtccccctttttttttttttgaggtgagtcttgctctgtcacccaggctggagtgcaatggtgtcatcttggctcactgcaacctctgcctcccgggttcaagcgattctcctgcctcaggctcctgagtagctgggacaacaggtgtgtgccaccgtgtccagctaatttttgtacttttagtagagatggggtttcaccatgttggccaggctggtctcgaactcctggcctcaagtgattcgcttgcctccgcctccccagtgtgctgggattacaggtgtgacccaccgcacctggccgctttttgtttttaaaatatcagtttccaacctgattgacagtttgtcctcaacagcatgggcagagatgggatcctggctgctggtagcggaagagggtgctgtggtcaggctctgtgcacctcctccctctcccccttccagatgctccttcccttggtgctgggcacaggaaggacaggtggagaggcttagttctatgtgtcttccacctgcagagggtgtatgggggttcctggtcttgctgtggtccccccggttctgtctgatgctggtgtggcacctgtgtcttcctgtggtctcatctgtggtatataatcccaccctcttttcctggtgctatttcccttacccttgaagctgcctggacaggccatggctcctctcctgctgctctcccaacctgaaccttcttgttgactcagggaaaccactggagtcttctttcataccctctgagggccatagagaatggtattccttcactgaaggcaactctagtctttgcaagtggttttcttggagtccctcggaactggctttgagaaagggaaagcatcctcatcagtttcccatgagaatgtgagggaataagaaaagtagctaataggccagatgtggtggctcatgcctgtaatctcagcattttgggaggctgaggtgggtgaatcacttgaggtcaggagttcaagaccaggctggccaaaatggtaaaaccctgtctctaccaaaaatacaaagaagttagctgggcgtggtgatgcacacctgaagtcctagctacttgggaggctgaggcaggagaattgcttgaacccaggaggcggaggttgcagtgagccaagattgcaccactgcactccagcctgggtgacagactgagactcggtctcaaaagaaaaaaaaatgttgcactaaacatctttttccatgttaaggttgtctgtctgtatttaggaatggactttccttatgatagactccactctgtgatgtgaaatttgtacatcaaaggatttgaacaattctaagtacaaatttttatatgtgtgtgtgtttgtgtgtgtgtatgtgtagtacagttttaattgctcccatgatacatagtcattagagaaaacccttgttaaaaaaaaaaggagcggggaggagaaaggaggcaaagaaacacgtatatggatttgcgtcttccatttgccttgaattaaatttaatgtcattaaaaaacccactggccaggtgcagtagctcatgcctgtaatcccagaactttgggaggccagggcgggaggatcacttgaggccaggagttggagaccagcctggccaacattgcaaaaccccctctactaaaaatacaaaaattagccaggcgtggtggtgcacgtgcctgtagtctcagctactcgggaggctgaggtgggagaattgcttgaacccaggaagtggaggttgcaatgagctgagattgtgccactgcactccagcctgggcaacagagtgagattatgtctcaaaaaaaaaaaaagaaaaaaaaaagaaaaatagctaatacttacatagtgcagttctaagaatgttaaatatttcaattgatttaatccttgtgataaccatttggagtagacattagcctcattttatggactagagtggatatatatagccctacatcacacggtttataagttggcagatccaggacttgaaccttgtctttcgggcttaggtgttacatgtcactcttgtcacgctgaagggtccttcttttcctctctttatattgatttcctctcttatattgactgaatgggaggcaggggagtggtaagggcaggggaccagttttgacacctcttggaaagttgtgctgtagtagctggcatcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctgctatacagggtctgccaggaactgctggagaaaatcttgtaattgtgctggtgttacatatttatggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctgatcacgtatcactgtcaaccaatgtaatctactgtcccctccatcatcacacaatggatctacttcagttaagttaccaacatcttcctaaaagatgaatccagcaggcatttgtgtctttatttttgacaactctgctctgttgtggattttgaccatctccttctggaaacatcgtctactatgattcctaccacaccactgctggttaaacttttaactctctgttcactatgttttattttccagcctctctttctctgtccaactttttaaaatcagtgatcacgaggagtttgctcttggtcatctagtcttttcactcagttgatgttttgtgtatgataccatgactctcatgataacccatgtggtcacctgttcataattcctgtcctgacatttctcttgagctttaggcagcctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggggctctatctttcttacccctaggttttttaatgtctaaggcctggaaaaggaggtttacagttagcagtattttattaaatacttaactcattaaagtcataaatgtaaaactgattctacattaaactttaaaaaataacttacaaattttataaattcatttgtaaatctgatatttatgttaaaatgaaaggcactccagcctgggcgacagagactccatctcaaaaaaaaaaaaaaaagaaaggcacttatctttgaacagtgtttaatttataaatttaaccaattaaatccctcaattaatactatttataaattctgttaatttcccttaaacattttaaagtgtagtcatacgtgtaatcatatgttcaattagtcatccagttctcacagagatccaaatctgatcaaagaaacaaatgtcattcactaaataaatgtttactgagtgcctagcatgtgtggtaactgctccaggcttggagactcagtgattaatagtcaatgaaatgaccactgaatggtaaataccgagaattgtgccaactgtaaacctgagtaaatgattattagtgttttaactagtgtcactgcaacctgagtaaagtatataaaatcctatcagtacacaggaccttagaacaaacaaatacacaacaattacacagtagggcctggccacagaatgaggagatctgaataaaatcctggaagatgacactagaacccaagagcctcgcaactccctgatatttaaaagctgcattatttcaggaaaaggtaccagtctgctgaaaaatggacacatgacactggagaagatcatctgaaagggagagggtcgggaagtcctgttgactgctgatgtggcagctatttgatgataatgaggggctgaacaaatgccagctcagatggaatcattctggaaggtgcactcacattctgagtccaggccctaatctccagtcagtaacatggagcttgactttattgtggttcccagtattttatggggtaaccacagctgacctgaggtggttattgtgctgtccttgattgggcgaactacttggaaatttgagataaggaaataaatccctggtgtcaatgcttctgtattggatataatgatagtaataagatatattgatagtaataagctttgcaggcatttttaggtgtgtgttttgttgctgcctccttttgagcccctcttcccggaccacacttttgctggagttcacagagcaggctggagttcatcaatgaagccctggaccaatgtggccttcaggccccacatgctgagccctatcaagtgccatatctctctccactattggtcttgggtgagatgctgcattgggggcctagaacctggcttctcgagtggctgtccaagggctggagggtgaaacccggaagtgttgggtctttggctcctatggtgaacctcaaccaatgggagaggataggatggcactgggcagatcaatttcccttcctttctcccttccagggactactctgaggtgcagtttcttcttgcagctctttgtgagaaagtccggtgtgctgatggacatggttgcctagtggcctggagtgttttgaaggtggctggtgcagttacaccctttatcccacaatccttggactctttcttggccttgctctctttcctcactcttacctgggctagtaactcgcacaataaattgtcactttaatccttgtctcgggctctgctttctagaagacaggggctacgaaggccctttgaaaagagttataatcatggattttggaatatttcttgtcctctgtgtatccctgaaacttagtactttttggaattggcttatgcttttaatgacctttagaccagaaaatattatatttttaaattgttttcacctgacgtttttagtgttccaaagttgtatgcttatcagaaataagcaagaactctgcaattctttgaaggccaacagcttgttacactgtttatagcataattaacaactttataacatttatgaaagtaaatggattaaatttgtaattattgtctggaaaaactgtatttttacattttatgaaacttaagcgactcaagttatgccatatttcatacataagctgaactttaattttagattcatgattagtacatcataaaagtactttctgtgctaacatttttctcttcctgacttatatatttaaaaaaaattccctttgctaatcatgatcctgtttaatattcttgggaaggttagaggtggaattcagagtgagattattggcatcgcaagaggaacagacactgaaaggtcaatttattcaatttcgtgtttgggtgcaagatctcagttactcgtcctacacatgagaaaacccttcttgcctttaagatttactggcttctggctgggtgcagtggctcacgcctgtaatcccagcactttgggaggcctaggcaggcagatcacctgaggtcaggagttcatgactagcctggccaacatggtgaaaccctgtttctactaaaaatacaaaaattagccaggtgtagaggcccacacctgtaatcccagctacttggaggctgtggcaggagaattgcttgaacccgggaagctgaggttgcagtgagctgacatcatgccaccgcactccagcctgggcgacagagtgagattccgtctcaaaaaaaagaaaagaaaaaaaagacttactggcttctttttagacacagtttgcaggaaaggaagggaacctaataacccattagaaaaataggtgttttataaataatgttaattgcagctatttcacattcagacaggtataaccaagactaagcttcactctaggaataatataaagttttaatcagaagaatagtttcaagttcttagaagaagtggtgtgtctttagatcaagtgacaactatgtgtctaaattatagcctttacccaagggtctacagactttttaggaatgaccttcacctgggtgggatgcattcccctcatcagtgtgtggaaatggacagcggatcagcatcccagagcctaagggtttgccgagttggtgatcaccatcagcagcaccttccttgggtgccccagggcaagtgagtaaccactgccatgtttggtgtaatggtgagtggaggtatcccacccacagtaggagacaggagaggccgaggcctccacacccacgtgtgcatacttcctggattcagcatgtgtctcccaaattacccaggaataggatgtaatgccttgtatctgtgacttttggaggtaccttatatatgcctgtgtgaatgaataaatggatggatatgaataaatgaatgggcctggggtttttgttttgtattgaggcaaagtctcagtctatcacctgggttggagtgcagtgtgccatcatggctcactgtagcctcgaccttctggggctcaagggatcctcctccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggagcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattattacatttacatatgttcataaaaatgcaaaaatgaaatgtactggcttctaacctgcttttctcacttaatatattgtgatgatttttctatgagaatatggatccacatcataatttttagaagttgtataatatggaaaaactacaatttatttaaagttttctaattgttagatatttaagttgttaccagttttcactaataacaataagtaaaatttattgagtgtttgctgtctcagattatgagtttaagatgtttatatgcattatttcacctaagcctcaacaaccttacggggtaggtattttgttctcccccagttttacagatgagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggaggcagatcctctgcctttcagatgactgcagccctggcccacagcttaactgcaggctcatgagaaatcctgggccagaatcacccacctaagctgctcctggattcctgactctcagaaactgcgtgagataacagccatgtgagctgttttaagctgctgagtttgggggtaattttttagcagagtaatagacaactaacataactattctgacttttataataataatttccttctttatcattacaattttaccaccaatatgtatgcatctctaaacaagatagtttaggtttgcatatttttacctattttatacatgtattttaaaattgggtcttatctcgatattaggcatatccctatagttgcatatagccagcgctcattttatttgcaatctagagattcattgtatgaatacaccacttacgtacgtatctgttctcctgttcgtggtcatcggtgttgtcctgggtttgagactattatgaaaactgctgcagtgaatattatgggcatgtttcctggtgcacattccacaggcttctctaagttgaccttgtagtgcactcgctggctaaaggacatcggcatcttcactttttctttaacattactagataatggccaaacctcatcaaataatgccagattatactccaatctgcaggacgtgaaagttcccattattttacatccttgccaatccgtggtattattggtctttctgatttttgcccatctggtgagtatgtaagtgatatctcattgggattttaattttgcattccctgggagtcaagaggttgtgcactctttcatttattgattgactacttgaatttcctttttttttttttttttttgagagatggagtctcactctctcatccaggctggggtgcagtgatgcgatctcggctcactgcaacctctacctcctaagttcaagcgattctccgcctcagcttcccaagtagctgagattacaggtgtgtgccaccacactcagctaatttttgtattttttagtggagacatggtttcactaaatgttggcgaggctggtcacgaactcctgacctcaggtgatctgcctgccttggcctcctgaagtgctgggattacaggcatgagccactgcgtccggcctgaatttcctttttagtgacatgcttgttcaagtattttatccatttttaagaaattagttgtctttatttatttgtagcagttctttacatattctggacactagccctttgttgttatatgctatacaaatatcttctcttactctgtagtttatcttttcactctctaaagcctaatgatgtcttttgataaaagaaattattttactgtaatagggtttattaatcttttcccatatttgttttttaacatgtaggtttttttcgtagttgattttattagtctttgccattatagttcctgacttttgaaatcctgtttagaaaggcatccctactctgagattacacaaatattcacctacatgtggtggttttatttttatgttttcatttaaaaatatttaaaccattcatctgaaatttttttaaagctttggttataacattttttttccctgaatgtgatgaatacggttagcaaatttacagaataatctgacctcttcctactgtaaatgctacccgtattatgaagtgggatcctatatattggctgtatttctgagctttctcttttgttaattgctcattctgttgattctggcactttctgacacctacttgtagttgttgtgctctgcgggacacatctgatagggcctgctcctgcacgttactcttgtttttcggcattgtcctgacattttttacatttttgttttctagatgagctttaggatccctttaatattaacataattatttttggctgtgttgtagatttgtctgtgacttgttagaaattagtgttcccacttaggaatgtggcatgtcttgccatttacttttgaatctttttatgtccctcagaaaaattttgtaggtttcatttcaatagaggtctggcaaattcttattctaagtttttaaaattttttgtttctggtgtgaattggcccttttctcctatgcgttttctgatgcataggttttcaaacctccactccttcagcgataaaggctcccaaggagtggctgaaggctggggagcatcgcagctctgccccatctgtttaccgtaacaggttttgtttatagaaatcattctcttttgctaaaaaaaaaaaaaatttcctgattggttgttactgaggtttgaaaccctgtttttgtgtacgcttttttttttgagacggagtcttgctctgtcacccaggctggagtgcagtggcacgatctccgctcactgcaagctctgcctcccgggttcatgccattctcctgcctcagcctcccaagtagctgggactacaggcgcccaccaccatgcctggctaatttttttgtatttttttagtagagacagggtttcaccgtgttaaccaggatggtctcgatctcctgaccttgtgatccgcccacctcgacctcccaaagtgttgggattacaggcgtgagccaccgtgcccggcctgtgtacacttctttttaatgaatgatctttactgatatcttttgttggttttaattacttttttagtgattcatcttggatcttccaggtattcattcctttattattattattattttttttttgagagagagtctcgctctgtcgcccaggctagagtgaagtggcatgatctcagctcactgcaaccctgcctcctgggttcaagtgattctcctgcctctgcctcccgagtagctgggattacaggtgcatgtcaccacgcctggctaatttttgtagttttagtagagatggggtttcaccatgttggccaggctggtcttgaactcctgacctcaggtgatctgcctgccctggcttccaaaagtgctgggattacaggagtgagccaccgcgcctggcctcattcatttatttattgaaaaaatatttattcagtgcccacccactgtgtaccagacacatttctaggtgcttggaatatatctatgagcaaaatccatgtatatcatatggtaagctcaaaatgagtatattatacggtaactactttggagaaaaagaaaatggatcaagggttctagaggtgggatatgggatccaggcagaattttattttattttactttattttatttattgattgattgagacggagtcttgctctgtcaccaggctggagtgcagtggtgcgatcttggctcactgcaacctccacctcccgggttcaagggattctcctgcctcagcctccggagtagctgggactacaggtgcgcaccaccacgcccagctaatttttgtatttttagtagagacggggtttcaccatgttggctaggatggtctcgatctcctgacctcgtgatctgcttgcctcagcctcccaaagtgctgggattacaggcttgagccaccgtgcccagcccaggcacaattttaaataccgtggtcaccataggtctcattgagagggggacatttaaacgaagacttggaggtaaggacgccggctatgtagatatctgctggaaaagcatgcttggcagaggggaaagcctgtgcaaaggccttagaaacacgctggaggtgttcgaggatcatggaggggtgtggctggagtgcagtgagtgagggagtcaaggttggttagggagggatagagtaggggacagatgtttgtatggggccttagtgtaaagactgacactgagtgaagagaggagccattgcagagttctggaatattgtagggacaagatgggcttacttttttttttcttttgagatggagtctcgctctgttgccaggctggagtgcagtggcacgatctcagctcactgcaacctctgccttctgggttcaagcgattctcgtgcctcagcctcccaagtagctgggattacaggcaggtgccaccacacccacttaatatttgtatttttagtagagatggggtttcaccatcttgttggccaccatcatgttggccaggatggtcttgatctcctgacctcgtgatccgcttgcttcagcctcccaaagggctcggattacaggcgtgagccactgctgggcttacatttttaaaagatcattctggttgctcctttgagaatagattttagaggggccggggtagaagcagggagactgattagaggcgattgtaacgctcctcacctaggatcttactgtgcattgagcaattggtaaggcttatggaatgaatgtttttacctacatcgggcattttagcgtgcattaagaaactacacatttaaaaaatacatatttttcttgagaaagtgatgggacagaaaagtgagagcaggggaattgcctttggaacaggccattttggtcaagccttgtcctggataaagaagatggggaatgaaggctgacctgccgtggaggggaggaatgggcaggcatgccctgcctcatctcacggagtgagggcagaatctggggagcgcgttcttggatgtcccaccaactttggagaggaccggaggctggggatagacaaggactactatgatgaaggaagctcgtaagttcgtgtttgcttctaaatggttgctgtggctttctggctttaaactggtttatattttctgcaacctcacttcttcctaactatttagtagaccagaacttctcggtaatttattgctcaatagtgggagaaaggaagaacttcgttttcaggttaagacttcatatgtcaaatccagttttattggtgtgataaatgctggtttctgttaaatttaccaggttggtcagtactggttcctgatacaagaactgtatttacccttttaagaagatgatttaaacttctggagaaaggaagagggcaaagatctttaaagagtatgctatttttatgacgcctccctaattattcagaaatatgaataattcaggaatttaactgtagaataagtataaattacccggttactgccttgaaagagtttacaatcaccttgaagagaatcctgccctcacccccaccagtttcacaaagcctattttaaattatacccttggaaaaattaaatcaaaacactgcgcaaatatgtttggtgtggagttcattcctttgatttagtcctttcactttgggcccacacacttttgccatcctttagggagcatgcccagtgctagattcgaagcgaatatattaatgtatgtgttcacccatcaatgccttgtgctgagggaaaaacagaagagagtgtcatggaaggcttaaggattctttttttttttgctgatacaaagtactttttgttattcaatgcttgtgccatcatcagacaacttcatccagaatgcacagcaactctgtaatatagctctgcctggtgcaaaatacctcattttgtatagaaatgcaggattgcttcatgtagatacaatagaaagaatctttgctttattcatgtatgaataaaacgtctttgttcatggaagagaaaagtgcctcttattgtttggaagctgtgtgaattttaaattaagctgatggtccactatattacatatttcgggggaaaaattagctttgcttatataagtttggaatctaatgtctaacctagtggcctaaataatttttgctttgcagtttgtttattatgtaaagacattgtgtttgccacagacattgcctgtcaatgaattgctttagcaaaattctatagtcctaattttaaaaagttgttatttattcccttgtcccacataagatttgaagcagcttgcaaaaaattaaaaatacaatgtaaataacagtcataaatcatgatcagagaaaatataaatattttatggaaaagtcaaagcttgtagaggcatgtgtgagtgtatttatgtgtcaatatacatgtaaaagggtccatgaagcagctatgtggatcctcagatttgatgttgagcttcctggcagccaaagtggaaaaaggaaggcaatcagttaatcctttctctgggtttgcaaaggactgcttagagcatatccaccgccaagcaggggtatggcattcgggctttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggatggacagtcactctccatgagtttttgcaccatgtcagcactataaactcactgcagtgggagtttcgcattgacaagggtcttcagacctagctcacctcagaaggtaagggggccttgacaggtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagttttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctgcctccctggcctccctactcctccatcccctccaagactctcaatgtagtcagcgctctgttttccccacctttgcctggctgccacctccctccctccctctccctatcagcttcctccggatgaggtgctattctgcatggaccccttagagtactcattaactagatgaataagctgccagcaatattgttcctgcttcccacattttaaaaaggttatctctttctttttccttctaaactttagagccatttgaaaataatcttttggaaatatatttacataggtctcatgacaaatccacatactccttttcagacaggtttcaacgactgcataatgagatggtctgggtcagctttgcacaaaagttgtacttttcctgctgtgaatctgtatttttccgctgtgtgtatttgcaatgactttcccgccctaccttccactagtgatgcattaatcacagcatggagctgagaggcgtgggattggaagggtctttgagaagttttttaatcgagctagaacgaggtcaaggttttgagcatttaacttgtgggatgttaattacttggctatgaaaaggaaatttgttttctgaaagttcaactgtagctacagaataaaggccatggaaagataaggcatggtgtcaagaggtttcatgatcttattccacctccttttcaggccccaactccactcaaaccctccactgttgagccacactggatgtgtcaccctctgtccctagacgtgctggacatctgcatcctgtggtgcctcggctcaggcttctctttcatctgggaaaacccttgaccctctcctagacttcccaaatgctgcttcaaggcatcatccctgccctccttcctttagaaagtcttttctaccactgagaacacttccctcatgctccaccgcagactgtacttcatgctgctttgctctttgtggttgatgcatctgtctctcccactaaatcatgaccctccattcatttctacttcccactctacccagggcatggtaggtgctcaataaatctttgctgaatggaattttttcatctaacccaagagcaacctgagcagaaaatcataaatgaataaggatcgtaaatggatgatcatcataaatgactaatcatcataaatgaatgcttatgggatatacacaaattgcagaacactgatagctatggcatagctcttatcctagagtgagtttcaattcactttaggttaggacatagaaaagacaaggagaaacaactagtccatgaggattttttccatgctttgttctttccatctgtgctgttcagtagctagtttcactgagcttccctgtagtggatgggtagagattgtgtattataagtacttgctcatcagtggctcaagggcaaaaatctcagtgcctagagtttggcataatattatgtgaaaaataattttttgcaatataatgagatgtgacactccccactttccagaacaaggacttgtctcctttggatttccagacctaaagaagaacatctcccttgaaaaacttttcccactggcaattcagccctctgttttccaaacccacttagaagctaagttgcactggaaatacacaatgaaatgtttatgggaaaaaggggcatcatatccacaatttgttctcaaaatgatttagtggagggagagagagagagagggtggaaagggtgggttggagggagcaaaagagagacagagaaaattgataaaataaatgagataaaattgagggaatctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatagctttaagacaactataaactccaaacatttcaaattaaatgcaaataaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtacagactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtctgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttcttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggcgtgagccaccatgcctggccatgagtttcattttaatttgtgtttccctcattttgattgaggttgagaaccttttcgtatatttattggtcatttggatttcccttgttgtgaaaggtctgcccaactattttgtccatttttctctttttcagtcttcttattgatttgtagaatatatattcattctggatataagcccttgtcggttttatgtcaaaattatttattttgcagatctctctctcttcttttaaaaataattttaacctttaatttagattcagggggtacatgtgcaggttttttatatgtgtatattgcatgacgctgaggtttggggtacagttaatcatgtcacccaggtactgagcatattactcaaaagtcagtttttcacccctcacctccagttctccctcccccttctagtagtccccattgtctattgttgccatctttgtgtccacgagtacccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccactgctcaagtttttgtttttgttgccactgcttttgaggacttagtcataaattctttcctaaggctgatgtccagaatggtgtttcctgggttttcttctagaattcttatagtttgaggttttatatttaaatctttaatccatcttgagttaatttttgtatatggtggaaggtggtggtccagtttaattcttctgcatgtggctagccagctatccctgtaggtgtgcagctttatttctgggttgtctgttctgttccattggtctacatacctgtttttgtaccagcaccatgatgttttagttactgtagccttatagtactgtttgaagtcgggtaatatgatgcctccagctttgttctttttgctggtgattgctttggctatttgggcactttttagattccatatgaactttagaatagttttctctagatctgtgaaaaatgatgttgctagtttgataaggatggtgttgaatctttagattgctttgggcagtttggacatttgaacgatattgattcttccaatccatgagcatggaatgtttttccatttgtttgtatcatctatgatttctttcagcagcgttttgtacttctcctcgtagacatatttcacttccttggttagatgcattcgtaggtaattttttgtgtggctgttgtaaacaggattgcattcttgatttggctctcagcttgaatgttattggagtatagaaatgctactgatttttgcgcattgattttgtattctgaaactttactgaagttgcttatcagttctaggagccttttggtggagtctctagggttttctaggtatagaatcatgtcatcagtgaagagaaatactttcacttcttttcctatttggattccttttatttctttctcttgtctaattgctctggctaggacttcctcttccactctcttactggtatctgttggtcagtggaagttcttaattttagtgtagtcaagtttatccttcttttccgtatatggtaagtatctatacgtgtaagtgtttatacgtagctgttttagacatctttttcaatcccagattatgaagctactctttatttcatcttctaaagctttatagttttgtttttcacatttagtattgtaagtcaagaactgtggagtgtctgaaattttgccttacttgcaagctaacaagttagcctgccttagtgtcacgaatgttgccagaagacacaagactccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcattgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactacctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagcaaaacctcaactttttaacaaaagaaaacaaaccgtagagcaaaggagattttctttcattagccagggtccagttaggatacaggaaccgtgctaagtatttcacatggaagggatttcatacagggatctggctatacagggtctgaaagtttgaaaaaattaaaaatggacactacctttaggtgctgggtgacaaaagggaagaggtggcaatataaaatctaggtgctcagagaaggagctaccttggatggtgctgaggatggggaggggagagctgggaatggaatggcccaggagataccacagcgctcctgctttacccgctgctggaaggatgaccgtcaaggctaaaagcaggaacacagtcctttcttcccagctccttctttccactgtcacaacataaccagaagccagcagcaaggaagcctgagaaatgtagattgcagagtagaatcactgagtggaggttggggctgagagacaataggcaaataaccagcacagagtctaagcagcaaaccgttcagattagctcctcctacaacaatgtgaaaattggaatgctcattttgttgctacttctaggaactgtggcccgtgggtcagttgggaattaatggcaaataaaggagattctggggcagtgtttgcttatgtgttgtgtctgattaatttccaaaatcaagctgaattaattttggatttatatgcattcatttttgaggtcaaggctagaggtcataatatctgaggtctcattctcgccacttttcctattgctggaatagtggtgctatgtcggggagaggacacagagaggaacaggcactgagaaagggagggaaatagtgggttcagaattgggacatccaggaggcagctggaaacgtgagtctggaactcttgggtgagatttggggctaaagataacaatttgggtgcttgatggtaagcacatcctttgagagtatatgcagtttcccaggagagaatgtgggagaagagttgagggaagggttgaaaaccttggaggacaccaacattttcaaagttagaggagccagcagaggcgagctcatcctaatggagatcacttcgttcaagcagattatttgcttgaaactttcatctttggtattatttgcactgtagtggaatgaacaaccataatgtgagtttaaaacccagataccaaaatattgtttgtttatagtctccctcaaactccatcttccgtaagtgctggtgtggggattatgtacctcttcacttctcttctctgcactgttgataaaggaagaggcaggttttgctgaccacattttggcaaatctgttggctctttcttgggcattcccatgctcatggtcacaatactgttactacgttaatttaactctagaattgagtttaagccactaatcacaatttctttttcttgctttgtcattatagctgctttttgaaaagcaaaattactaaatttcttaagtcaataatttcaggttgacaaagaagaggcaaaatatatgcaggctttaaaacatgctctgagaccacagaagggtctttttctgatccaaatatcctattaaaactgtgtgactataggaaaaagtctgtgtaggctagagcaagttcagttgaaaacctatttttaaaaacacttaaataattacctttcatcctaaatcatagacatggtcagcattgtaagaaaagctgatacacccaaatctgaatatatatgacaaatagatcattaacaccctttcattttaccaaagtattctttgatagtgcctttaaataagccagtttctaaagtaaatttaaaatgtcttcaattataaaaaatagatttacatgtgatgtttcaaggacatatcttgtgaaggaagtacagttgtaaagtgttgagcaaagtcatgaaagttttcacaagaaggaaaagaataacatttatttctaccttttcttttttcttatcagcatctcaaaatagaccaacagtatattccattgttactatttatttgctgcaatacaaatgacatctcatttgattttagccctttaaccttgagctaaaatgaccctgtggaaacaaatgagcactgtagagacacctgcccctcagaagagtttggaagggcagagttctgtgggagagtttgcctaggaagtggtgcggggtgggctgcccgggaagggtgtgtggagtagagaccaagaaggggctgaacgccatctcccaggaagcttcccaagactgacttttcttatatgtggcctccaggcagaggtggggaaatccccaagccttcccagagggcagtgaggctttctcaccttaacttttgagttaggaattagttcacattagcagtttttggctccctgaggctgagattggggagcttttctgaaatcatggaaatttctggcccttatctctagatgaagatcccaccttaattttatgtatccaacatagcctaaactattgttctttttttctgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtcatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatactatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaagcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttcttttttttttttttttgagacagagtcttactctgttgcccaggctggagtgcagtggcacaatcttggctcactgcaacctctgccttcgggttcaagtgattctcctgcctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcttctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatggatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggtttgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctatcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatgtgggaattccattttttcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtgtttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctttattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaagtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatcttagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccggctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactgtagcaccaaggcaacctgagataggtctaatttgcagcataaatcttcttttccactgggggaagaacacacgagccacattgagtagccacccatttgtatttttgatttgcaacttctgtctagtgagccaaggtcaggtgcgatatttgtgatggggaagctgaataggtgagtgagggtagcttgtgtttgaagctgaagaaggtaattaagagggttttagaatgtaattttggcatttttccccactccacctcttcaaactatgtgtcccctgtcatcgcctaaccgatctgcctgtccaccttctggttcctctccagtccattatctcatggcccacttgactaatctttctgaaactcagatctgttcttatcactcacctttctaaaagtctccattgtccccagaattaagtttagccccatggtctggcccctgagtgtatgcctgtctgctccttttcatttaagcttctgttacccttgctgaattattatgctgtttcctgttatgttgtgtgcatctcttagaagctgcatatagctggattttttaaaatccactctagtattatttagtatgttgaatgtaatccaattgtgtagataatcattactgatctatttggactctctattttttaatcagccatttctttgcttatactattctttctgacagaaatgccacttttcttcttatctccctggtgaactccatatatcctactaggctttgttctggaactttcttggcaccttctcatttatataattgcttccttccatctgggttttaatggcaagttctgcatctctattacagaatagtattgatctcattgtggattgctgtttgtgtttctgctttccagtgggcctgtgagagtgactgatctttgcatctctagcaaattggcacagttggtagactttccaacctgagatattagatgtttcagaaattagattgaatgacgtggtgtcagtttgaaacattaaattgaggtgttctttgaaatgtatttaaggttatacaatgatttttgaatacagctttagctgcataccacagattttgatgtataatatttttattgttgttaaattttttggtaatttctattggggttttctttttaatctgttatttaggacagaattttaaaattttgtgctgatatacttatttttattgttggttcctaacttaattgcattatggttaaaaaccccaaaacctaataaacatgctctatatggtattgattgactttgttacgtagtattaggttggtgcaaaagtaattgtggtttttgccactacttataatattttgcagcaacataatatatggtcagtttttgtaatgttctatctgtacttgcaaggaatatacattttttaaatttattggctgggggatatatgtatatgtgcataatagttgaccaaggttattattttggtcattcagataatcaatatctttttcaattttttatcatgtttgatatgtcagttttctgatggagttgtgttaaatctcctgctgtaattgtgggtttatcagtttcactatttcagttttgctttatattttttggaggttatactaatagtggaaacaatatcattattataaaaattttggtggattgctccttttattattacattgagtctctattcctattaatgctttgccttaggaaggtatttcttaggtcaggcacagtggctcatatctgaaatcccagcactttaggaggtggaggcaggaggatcgcttgaaccttggagctcaagaccagcctgggcaacatagagaaaccccatctctacaaaaatacaaaaatgagccaggcatgatgctgtgcacctgtggtctcagctactcctgagatcacaccactgtactccagcctgggcaacaaagcgagaccctgtctcaaaaaaacaaaaaacaaagacaggtagctcttgtctgatattactgctgcaggctttattttgattagcattttcctagtatgtacattttgtcttttcagtctttctatgtgttgtgttttagttgtgactcttagaagatgtatatagctagattgttaaaattcactctattattatttagtatgttgaatttaatccaattatatagatgatcattactgatctatttagacttattactatctgattttgtggtttctgtttgccattccttcttcctccctctccctttattctcccttgttttcttttggattgaaaaatactggttttctaacagtgtgctggtatggatactatgttataacatgcatagttctatatgggtatcatagttttgtgtttttaggagttaccattagttatataacacagatacctgctgtgcattattgtaatgatgtctaaagttatacccatttctcacctcctcctgaacacacatgaatcttagtgtgcttgaaatatccactcaacacccttccccatttctgtgttattattgctgaaggttttaattttgcccttgtgtaaactcagacacattggtttttgcttgtttgtttgcctttactcaatggtaaatttaccaccatagtttctcaatttttattctcaccgttgtttcctatggtccatactttccctcttggttcggtttttatttccttgatgtaatactttagcatcactgttatttgagtctgtgaagtctgaatatgtctttattttctttctctcgctcttttttttttttttttttgagacagagtctcactttgtcactcaggctggagtgcggtggtgtgatctcagctcattgcaacctctgcctcccgagttcaagtgattcttccattctcccacctcagtcttctgagtggctgagattataggcacgtgccaccacatccagctgattttttttttgagacggaatttcactcttattgcccagactggagtgcaatggcgcgatcccggctcaccgcaatgtctacctcccgggttcaagcgattctcctgcctcagcctcctgagtagctgggattacaggcatgcgccaccacacccagctaattttgtgtttttagtagagacggggtttctccatgttggacaggctggtctcaaactcctgacctcatgtgatccaccacttcggcctcccaaactgttgggattacaggcatgagccactgcacccagccttgctcttaaacaacagtttagggagacagaaaattctagatttttattgcgccaccacacccggctaatttttgtatttttagtagagacagggtttcaccatgttggccaggctggttttgaacacctgacctcaggtgatccacccgcctcaacctcccaaagtgctgggattacaggcatgatctgtaatcccgtgcctagccgatttcttcttaacactttgatgccattccttcattgtccctggcatctgctgttgcagaagagaaatctgctgtcaatcttattgttgctttggatgttttttcccctgcgatagttttaggattgtttatttttgaggttttgctgcgtctgggtgtgaattaatattcatcttgcatggtacttgagtgtgcttccaaactgtagactcctattttccttcaattacagaagataaaagagccattttacttgtaaatattgattctcctatattctgttgtttttttctggagtgcctgttggatatatcttggaatctctcacttatccttcatatctattaactgatatttccttaaaaaaactcttcatctctgtttattttatgttctttaagttccttaatattttccagcttaccagttctttcctgattgcgcccaggctggagtttgtcccatctattgggtttttcatttttatgactatataatactttttgtttctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattggcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattgactgacctctgaaatataattaagtggcctaaacagctaatgctatatgtgtatttatacttaatgtatcaaaacagtaaacaccactgggaaattcaggaaaagcagaaacgaattatcatgactcttaacctgtgactcctgttgaaaatgatcccatatgttgtcttttcaaacaagatatattcatgtcactagtttctgttcttgaaagtagaaacactactccttctattagacattttggtttctgaaaatagaacaagtaaaacctgaacaagtgcgaactcgttcggattaaagggatttcgggtccaactctccaagccaaagggattttcaaatggttattttaaaacgtggatctacatgtgggcttctgtggtttcaatagtcacaggaaatgcaggccactgtatcagtcagcttttgctatataacacaccatccgaaaacacagcgacttaagacaaaaaaaaaagttcatttagtttatgattctgtgggtcagcaatttgggctgggagcactgggtgggtggatgtgctggtgtggttgatcgctgctgggctcactcacctgttgccggtcagctgccaggtgagctgagggcttgatggcccgaggttgctcaggtgggatggctgatctctgatccacgtggtctttcattctccaacaaggcagcccagacttggtcaggtggaagcagtcacagcggacctgacagagtgagcagaagtatctgtagagcctctttgtgagtactgatttggaatttatagctatacagtgtggtttacactcttctattggccaaagcaagtcgaagcgtggaaaaatagacttcttaatgagaggagctgcaaagcctgtggccacttttgtactctaccatggcaacaaaacgtggaggtgccactccccaccccaggagagattgtgtaactttccttagatcctcaggctattacctccaaagttgagaaccaatatgttggatgatttcactactgaacaacaacaatgaaaatgtttaggagagttaactgatggacacatctgttaaaacactgcttggtgtgtggaaatgaaatttttcattttttctattggaagttatgccttgtatcaagacattaggttaattctctctgacttctgtactcagcctgaaaagtaaggattcttgttcagtgtaccagataacttctattatgtggcaaaccactccaaaattcagtggtttaaagcaataccatttattggactcctgttcccatgcctcagcagatggggctgatctcagctggggtctctcacgttactgcagtcacctgcaggtcagctgggtggctctgattctggggatggactggttgtaccttggtgggtgtctgggccacttgtttctctccattcagttaatttgcctgggcttgcttgttcacagggtagcaacagtgtttctagagagtgagtagaagcacacaagatctcttcctgcctagctaggcttgtttctgtggggtcaaaacaagtcacaagcccagcccagattcactaggtgggaagatagactccaactctagctcggaggaactgtaaagacgcaggacagggaggatggagaaccctggccattttgtagtcttctgtatctgttgtcttcaagaaattccttctcacacttcgaatttaagtaaaatactatctccacttatatttttcctattaaatagtaataccgcatgtgtaatagtagtagtaactacacttgtatttaaaacaacctgccatcttttcacctttaattgatggcacctcccttactgtggatttgcatattcatattactattttaagggcgtagattatgttaatgtgttttgctaaagaaaatgattgaacttattttcttcttccaatttgtcttcctcgttctttaatccaaccctactggtgccagacttgcttttctaaagggtttctctgtgtttgatgaagactctttagggatctctcactcgtactctttagcttggcatttgagaatccctgtgctctgggcgttgcgtaactttcagattttattttcctccattcttccttgtgcactagttttcacagttaaacacaatttattgctgtttttttttcttagcacattggccatacacaaattgtcctcagctcttgggcaacatttttggttgttacaaccgtgtgtgtgtgtgtgtgtatgtgtgtgtgtgtccatgcttgtagtactggcctttagcaagcagagaccagggttgctgttaaacatcttgcagtgcacaggacagcccccacaacagataattatctgctacaaatatcaataaagccgaggctgagaaaacctgtcctatccattcctgcccctggctcttttttccatgcctcatcccagaaggcctttccttcagtgccgcccgatgaaatgttctctatccttaaaatgccagctcaaatgccacatcttctaggaaacacatcccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctcctcaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgacataccttaaattacttaaaaaaaactcttaatatacaaataggtgatgtatagctttgttactaacaaaatgattcagttgaaatgttaaatttaaaagcatttttccagagttttagttttggttgatggattgagatccttcttgcttacctccttttacctccaaaaaccccagtgagttacagaagaaatataaagtctattatctgttttattacagcagtgaaaagcatggaaacatataatacatgaccagaagttttaaaactttccagaagagatgcattagatggtattagacccacctaataaatgatacagaaatgagaaagtaatgggaaaaaatattctataattaatgctaaccatataaaaatagaggaacaatagtaaaatcaaaataaaatttgatgcaagagaagcactaaattaaaaaagctttttaattataaaaagatacagtcaatgtagtctatcaggaaattataatagttatgaaccattctgcactacataacatagcatctgaatttttaaggtagaaactgtcagaaatacatagacagttgataaaaatagaagtagacttcacatacctctctcataaaataatagattaaactgacaataatcaataggctcatggaggatttgcataaaatatgattaataactttgattataaataaatatagatatctgcattccccaaatggagaatgtgcatatttttcaaattcctttggaacaaatatggttatcaattatgtactaggttatagaaaaaaaaactcgataaatttcccaaagtgattccatagaacataagaattataagggaaagtagagcttctaaattctggatgtttggaaatttaaaaatatgtaaaaataattcttagtttaaagaggaaatggaaagtaaaatgacattatttaggcatgagtgacaattctgtatgtcaaaacctgtgatatgtggctaaactgtaaatgtatttaaagaaaataaatgttgggagaaaatgaataaatcatgcaatccaagaagctaggaaaataacagcaaattaaatcactctaggtagaaggtagaaatcaatatggataaaaaaagagattaataaaatagaaaacaataaccacaaaagatcgaaacaatgaagccaagagctttagaaaagctgtaagacaacaaacctctaccaagtgaggccaagagggagaaaaaggaaaaacacaaacaaattacataaagaagaagaaagaggatatgcccactgatagcattttttaaagagaatgctgtaaataagtgtcagaaatgagagctgctagcagctctctcactcagggactgggcctaagggagtcagtggcacaggccttgggacacctcatgggcagggtgccagcattaaacagaaattccagacttaactaaccaagatgctgtcataccaggttgacttcacaaaaaataatttttaccattctgcttccctctatttttcttaatggtttggcaggatatttgcatagcatttggttgacttgaacagacacacacacagaacacacacacacacacacacacacacacacacactatagtgtccctagttattctaggagggagattttgtttttaagctacatgagtttttgttgttgtttttttgttttgttttgaatgctcatcttgactccacattagccaatatgtttactcttcaatttgtaaagggtttatttctagttttgatgcttgggctggtgtggaggcagctccagtatgtgcatgtcagggcctacaaggtacctgcaagtttttggtcatttgtttcttgggcttttttgtttcaaaagatataaaaaagatctgaagtagaaaatatctccattctaattcctctcatcatcatctttcagagatgactcttagctttgtggtggcttttcatgtccaaaaagggttgtatatatcaaagggagcactctaagttatattttaattaatatctaatttgttacattataaatctaaaatcctcatttttcttaagctttaaactgaacttatgaatcttgtttccaaatttagtaattttgctatatgatgaaaatcattatagttaattttcatttgaggttgcattaattaacacataagcttaacagattcaatccttaaatatttaccaccagttatataattaagcaaattcccttagacatttcaagctataatcacaaaggcaaggtacaggactccctcaaactttacataaaatctattaacagcattttcctaagcccttacatttcttgtgactaataagacatatttagttaatcagattctcttaaacatttcaacgatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacctaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaatttgctcgtgtgtttctaaaaggacaaatccttagaagtataatagctggtttattaatatgcccattaataagcacttctcccttgatctccaaaaacgtatcattttgcattcctgttgtgtgttactccacacccatataatacctgatattgagtataactgattttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcaccctcaaccagctgactcttgaatgggataaggaagtgttggccaacaataaaagtgtcaccactggctagaggtctctggttattcctagagaagaggcagccctagcaacctcttatccagtttaatggctctcacccacatacctgctgcatcccacatccccctccaacagtgggaaagatgggcagagagagagagagagagagatgtgtgtgtgtgtgtgtgtgtgtagtgtgtgagagtgaagcctttgggcttggggacctggaggataaatgctttgaggataaatgtgaggttcaaaagtccggcactggccaggcacaatggcttatgcctgtaatcccagcactttgggaggccaaggcatgatgattgcttgaagccaagagttcaagaccagcctgggcaatgtagcaagactctatgtctacaaaacattttcaaaattagccaggtgtggtaacacgtctgtagtcctatttttactcaggaggctgaggtgggaggatcgcttgaacccatgagtttgtggccacagtgagccatgatcataccactgcactacagcctgggcaacagttgttgtttcaaaacaacaacaaaaaaggctggcactgtgaatgtcaggtgaatgtgagtggcactcacagctggcacgggaatgtcactactcacagtgcattctattgctggagatgcagaattaggctcaacccagaccgatggaatcactctacattttaacaagatccttgggttatttacatacacattaaagttttggaggcattgatttaaaatacattaaaaatagtacaaaattattaaagtaggaaaaaaagtgtatctcttgactatctaaaagtatctcaaataccacaaactagtatgtgattcactctctcacctacaggatgaaatctcaaatccttagcttggtgttcaattcatagtcacattttcccatagctatctcccactttgtcctgtattaatatcattttaggtcaaaccagcctactccttgtccactgattatgccacagtattccctcttctacacgttactgacaccattctctgtactttttagggcatctttccatctttcttcagcatattgccgcctttcccttgccctgcaccacactggactttattttcataattatgtcctgtatattctgcctcccagtaactagactttgagctccttgagggcaaagcctgtctctggagtcccagtaatgagcacagtgtgttgttgcacagggcccagtgcaacaatgagtaaatactcattgcctgagtcagaggaaggaaaggaaggtaagacgcagtgatgcgcatcacctccctagggagcagaggctgagctgcaccttgggaccagccacacaaggctagtgttcactaggggtggggtggtctgtcccctcctatgattctgcctcctaaacagcagcacctgcctgccataatactgaaaatcattaggctcaatcagtccttgggagcagagtgtgtgtgtgtgtgcgtgcgcgcgcatgtggtgtgtgttaatgaccagttggttgtttgaaatatcctcctcggcaattctatttttgtttacatttaaacaaacaaacaaaaagcatgtcagtgtcacacaggtgtcagtgtctgacttcacgtgtcagcaactgcaagctttccaaagggtctcactcgaggggtggtgctcaggaaagcctggtcactattatttcaagtcagcaatgtgccccatcatttcttttttttttctttctttctttctttcttttttttttttttgagacaaagtctcgctcttgtcccccaggctagagtgcaatggcgcgatcttggctcactgcaacctccgcctcccgggttcaagcaattctcctgcctcagcctcccgagtagctaggattacaggcatgtgccaccacgcccagctaattttttgtatttttagtagagacagggtttctccatgttggtcaggctggtcttgaactcctggcctcaggtgatctgccggcctcggcctcccaaagtgttgggattacaggtgtgagccactgcgcccagccgatgtgcaccatcatttctatggttcatcgtggctgcggaacagtgcacttagcacccaccttggtaaagaacctagaaaattacctgagaaaattaaatagttcacacacaattgtttcaggcctcaggtctctggcattttgtttaaggtgacctcagttttggcagctgcgtttattaaattctatgtacctgtcactccaccttgtaactttaaagaattacaaatgacaatgtttttaagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggtgagttattcagagatcagctgggggagctgagaactcctccagtatggttttaggttatacacaaacccttcagtctaacaacctttgttatttttccatattaccaaagtaatacatgttaattgcaggaggtttagaaaacataggtaagtaaaataaagaaaaatgctaacatcacccataatcccatatccaccgataggcccaattaaactctgttgagtatctttttttttttttttttttagacaaagtctatgcccaggctggagtgcagtggcgcgatcttggctcactgcagcctccacctcccaggttcaaacgattctcgtgccttagcctcccgagtagctggattacaggctcaagccaccatgcctgactaatgttttgtattttaaatagagacagggtttcgccattttggccaggctggttttgaactcctgacctcaagtgatccgcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatagcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcattgctgttttaactccatcttttggatcacgtgtgaggtggaatttttatttgtgtttgtcattgtttttgtgaattgtgtgtttgtgtccttagcctgcttttgcatcaggaggtccattttttcccccctgtctcatgagctctttaaatggtcaggatatttgctcattggctgtcttgtatgttgatgaagctttgtcccaggtaagcatttgccttcagaccttgtatatgaaggtcatttcaatggagagagatttttattttttatttactgaagctctttagtcttcctatatggtttctagctttttggaatcatgtttagaaaatctttttcatcccactccctggcaaatgatataaacgtttatttatacttgtttttgaatcctgtattttcttttattgcctttaaatttccaagctcctgcatttattggagctacagtgcaatagggttctaattttgttttctaacaaataaatagcttgtttcagtacttttgaaaagtccaactttctcctgatgatttgaaatgattcttttattataggctaaattattatacattaaatttgtttatggtctttctcttccgtttcttgatctgtatcctgttttgattcagtgtcatattgttttaagtattgaagttttaaaacatactttaatatattatttactaaaaatttaggtattgtattgcaaaaagttcacagacacacttactggttttatttttccaggtgaaacttaagtcccttttatttaaaaaagtcattaaattttgattgagattcatttaaattaatacattaaattgaggatgaattggatttaatatattaagtattcccaaagaatttggcatatttgctattcatatagtggtaacaaggcaggagatggaagagatggaagttgagaaatcaaatatttggccacagtaatcattctaggaaattggaggaaatatcttttgaaaaaaatgttaaaactcaagcattaaaacacgaattaattagtgacaaagggtaatattatccctcagagcagtataatgtgaattttattttattctaagggccaatggggacaagatggcctatttcttactctgaaggcacatcagtgaagggagcaggtgaaactgccaggcaggccttgaaatccaaggacactcctgccgtgcatctggccttggcgacagccagacaatttggtagcttcccaggtgctcggcaaccgaaaaaaacttgggatgaggaagagagctgatgtcagcagggcatcaggaacagatggatttctgctcttccaaggaagaggctgtgccgttggatgttttcttttggggggccacatactgggacctcctacagtacagaaacctcagtgggtggaggctgagccccacacccgtggaattcgacagcgccagtctcaggcaaggagagggaatgttgattccagggaggtggcggcccatgttcagagcatcatctttggagtctacagtgtatttgaaaatgtttctgtcaaggcgaaatgagctgacattgtgagacactggcactggtggcagaggggctgtgtagggggtcaggcaataccatttctcaccatttgggcaggaaagagtccacaggctaggaagggacatttcgtcttcatttaggaattatttagacacactttggagagttgagctaaggaaatgtagcttccaaggaggaatgaagctaccactgggtccgtatggagtcctgggaagccttagtttagagtaacggttcctacttctgttttgcaaggtcctctttagtatctttctgttttttttttaagggaggtgaggcacatgttgccatctctattttacaggtaattaagttgtccatgccctcacctggtgggtgaaacaactcaaaggtcagacttaggctgggctttacggtcttcttcaagcctagaaatggagcaacccaatctccatctttttacaagatcaatttggaaaaacccaaatataggaaaaatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcacggaggcttagaaccttccagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaaaatacagaaaataggaagccttgctttttctttttcattctgatccaggattcagaggtcccggagcaaggaccttgctacaccatcatccacacacttttggtaaagaatgaaataaatagcactgttaacctggagtagtgttcccaaagaaccttttgtatttatgttttctattcaaggcaatgcattgatagaagttggtgaatccatgaagctaatggctgaggtgaaagactctcttgatattaatgtaaagcaaacttttattgatccacttcagttactacaagataaagatttaaaagagatcggggtaagtcttccagggtataaatatacctgttgctacataagatgatgtttatatttaaaatcactagaacgtttcagcagactgaaagcatcatcttatgatgcttgtgggtagggtaaaaatgactcagttctattttcctgggctcactgggaaagagtgccaggatccattagtcctatctgccctggagatgaagcaggataatgggagggaatgtaagccatgttctttcagctggaaattctgtatttagttgaagccagctctaagccaggctaaacaaagtaattacataactttatagtggatttcttattatcaaaatcgtaccatagttgcatgttttgatgcgttgccctggtggtcattattttccattacttctcaagaagatcaatacctagaaattgaatttttcatttggaaaactgttaaaaatggcgtgcatgggaattttcaggtacctggagataattgcatgccacttgcatggtggcatttttgtagatgtgcaaaaacagccccaagacttctaccccaccagtgacttccactctggaggtacaagcaccgtcttatggatatgtacagaagatgttcctccaggtgccttcagcatgatctcagcttggaggtcatttgagccttgggcatatcctgttttcccttcttcagacctattgattctcaaagtgtggtccctggaccagcaacatcagcatcacttgtgagaaatgcaaattcttgggccccatcccttatctcctgaatcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccatacgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatagggtgtgtaggggtgggggtgcaatgaagggaggaaaggctgagagtcacggaaagccctggatgcctgtccaggcaatgtatttagaatttctgctgaaagcaaagggtatgagggagaattcaggaagtttgagtgagaaatgaaagcatccattcaggagctccctaaacatcccattccccacctgcacacccctcggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatacagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtgtcatgagcactgttgcttaccttttgctcatgttgggcagtccattcctcggggtgagtgatcgtggtttgttccttgtagtcacaagcctcccacgtggtttgtgctcacacattattttatttttttaattttaatttttgtgggtacgtagtaggtgtatatgttggtggggtacaggagatgtttttacaaattatttttgaatggttgattctagagaagtgacagtctgggttctggggatgccaaaacatctcccccaaatgcacagttgtaaaaccaaatgcctcctttgctgacatatagcaagttttatttcttcttgtgctgtcatcatggaggaaggtcatatgaaaagtcagcattgctcctccacctggccaaccacagacacatatgtggtcctgagtagtaagtgggtgaaatgtgtaaaacacacttattctgaaatgttgcagttctctatgcaacaaaatagttttctaaatgccatcttgttactcagctgctgtttgatacagaactgtaaatctaaacttaaattatgtggatgatggaaagttaagagtccaaggtttaggaagcctttcatagtctcagctatgctctgtgtcgctcagaaatcaggggtcaggggcctgttcatttgacatacggctgactttcaggtgttcatgtagaggtacagagggattagggaccagcccaaagtcacagagcaaagagagagatgtttctgactctctgggtcttgtgtgctcttttcactgagtcatggaagttagaagcagtgcttcctgctaaaatgaatagtgcgagctatccccatgcttcagtgggatgatcagtttctacatacactttcgatgcctggtatctgatttccgaggattatagccataaactctccagggacccctcccttgtcctgtatagctatcccactcagcactgtttctgacacggggtctctctgcttggacacaaactgtgatgggaaacctactgctacgcaaggcagcctgttccatgagtggacagttctaactgttatattttgttaaagcggttataatattgtttagaaattttactgtttcagaggttgtctgtgaatctctctcctttgcattcattaacagcgttttacgcaacttatttcttgattgtttgggaactttacggagatccgttaatattctaagggattgtagaagtttgtgattttatagtctactacttagtcaggagttgacaatagtaccaaaagaaatgttcctactgtgttttgtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttttttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtttgtgttgggccacattcagagccatcctgggccacatgtggcttgtgggccacaggttggacaaacttgctctaaagccttagttgttatgcaagtttctagaattttctcctatctcctgcctgagagattgattgcttcagacatccagcaagccctgactcacatctttttttggagacagggtctcactctgttgcccaggctggagtgcagtggcacgattgtgactcactgcagcctcgacctcccaggctcaagcgatcttcccacctcagcctcctggatagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctggagaatttattctcccaactggaaatgccaatttgaaatttcccatgcccattaaaccactgaggcctgaaaagtacactctactgtgtttcttcttttaattttttttttttttacattttttttgggaaataggaggaggtgtgacagtttggtatctctgtttttctttaaatgtataaatttcctcttgaaattgtccccaagcaacagcgattttgttttgtttcagattgccgtattgttttgaagtctttagaaaatgtatttgaagtgtgacatgtatcagatactccttgttgggccatatggaatgttgccctgctggctccaggcccattcatggcttaaactctgagattgtgtcttgtgtgtcagatgcgccgtctgacccatttgttccattcactgccttcatgcgggaaccacaatgatgggtttttgcgaagtgctccatgagggaagcctgtctgagccacgccggccttagcagttgacccaagagacctcagttttccccctcagtatcagtcaaaagtcagaaaggatcccttcattataaaagctcaatcatttgtccatgttttgacagtaacacgtattctgcctgtcacaaatgggttaagtcctcccaccctgccccagcagaagtaagagctggttcctagcccaagctccgcaggggctctggtgctggccttgctccggcctggttgcagtgtttcctccaaggcttcctgtgggaaattgacctgcaggtgagtggaggtttcccctgttcagctctggggagtcagggctgctccctcagcctggatcctggggtcttcaccttcacaaggaggggttgtctggcttctacttctgccattgaggtgggaggagaccaacgttatgaaacggagatgggccgcccaggctgcccgggaactaggctcttccctccttcctgcttcctgcttcctgccatctgtagctgcaatggctgctaggtgtgctctggctgctgcttcttgcggtaatggtggtgatcgtgataatgataaagacagtggtgataatgatgatgacaatgacaagagctaccattcactgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctgtaggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagtgagtccaggcacctgcagtactggctgtcttggtatacattcaccagctacgggatcctccttccattcatgggttcccaagaccagtggaattactagattccagattcctgaggtctttccattggtctagagtagcattttccaaaatccattccatgggatgttagtgtgttttgcattaataatgtctctgtggtcacataagtttgggaaaccctgggttaaataaaactaaacagtttctttatcacaagacttttcagagtctttatttgacagtatgaaagattaatctctaagcggttcctaacagaaaatacagttggcagtttaccaaacttatttgaccgcagaattccgtcacattattatattattactaatgtttcaggactgtaatgtgtggaataagatgcattaggaagtattgaacttgtagaaagcatacccagcaaggcgtgagatacctgaattctgtttctgattttgtttctgctaagcctctgggaaaatcatttcacctgactggtatcaggcaaattaacaactgcatttgagaaattctttagaaggataaagtggagaataaaagtgtaagggattattatccatgttattaatttaattgccttactcaaactttctcagaaactctgaataaaggcttttgccccattggaaaagtcatctgtttatgaccagactgcaaaatacatgagaaattttccacagcttctctgaggaatccaaaaagagtagaggtctttgatatgatagagcaagaaattactggtattattacactgtaaattgaaggtgacctctatgggaaatgtgccttttcagttgtgaaagagaatggcttgtcgtcttttgaagatgtacacttctttattcctgcatgccaaacacacttgcagaccccaggcgtctggacaggcatcagctactcacatcacagttctctctctgtcctcgccatgggcttcagggtgtgctactctctgcttactcacccggctgctcaccaagtcccctggtaagggattgctaaagggtcagaggaggagggttcccagccctgctccttctaggcaccccagtttccatagtcctcttgcagagttggcctaagacagccttggttacagtatgcagtcctttgagccattcttcctttgggtacagcctaagccttttgcagttggctcacaaggccaggccaatggctcagatcttatgcaagtgtccctggggtttccataactcctagaaacttctagtatccttagtccattgtagttggggacatctattctctgtttccatccccaggactaagatactcccaacggccatatatgctgctaatcatccattggtttccagctatagagaggtttggaatgaaatgcatccacaggtgacacacgtgtgtcacttgtggattgtttattgtgtatagtctgccatgggagataaattgagttaattcctgttttggggttatccctcagaagagagtgaggagccctgggatacagccaaaccaacaatgaagtccccaggcccagccacgatgggcccattaccccctgagcttggttcttatgcgtctccaggcaacaactcccatcaccatgaatgggggtccctgggcagcactaatctcattgttaggtttttgcatagtttgaggatgggctaaagcagctctgtatcagtttcctattggggccataacaaatgaccacaaactgtagcttaaagcaacacacatttattgtcttccagcctagagtcctaaaatcaaggtgtgggtagggccatgtttgttctggaggctcttgaggaagaagctgcttctttgccttttccagcttctacaggccacctgcatttcttggctcattcttcgcttcctccctcttcacagccagcggcacagcatcttcacgtatctcattctgacctctgcttccattgtcatatcttctctgaccttggcactcctgtctcccccttaaaggacctcgtgattacattgagccattcagacgttccaaaataatctcttcatgttaagatccttaactcaatcataaccgcaaagtcccttttgctatgtaaagtaacatatttgcaggtttggggaattaatatttggacatctttgcaggttccatgattctgtctacctcaggccccctctggttttatggttctgtgtgtctcccaagttgcttcttcacagccctcacttcacacatttgtcaaccaccgaggcctgtgcctccttgacctctaacctacatggaagtcagcttgcattatgagtttctcacttcaaacatcagctgagtgtgagcccatctgtaggagctagagtgcttcactttcagaaaagggagtggattctctggaaatccagttccttggcgtatatcacgtgaacattttcatgggtgaggtcacactttgctctcaagatggcaccagcacagtgtcagcccaggtctcaacccggaagtggaattaaacctttcttcccaccccaggtgactttctctgattcaacagatggactgctgaaattccaacaatggaagaaatgttttaccttttggtcaggttttggctcttgctaagcctgagtttgttgctttatcttggttctgcctgtctaggtatttatttctaatcgtggttcaggaagctgaatgtacctgtgttggtccccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctttagctctatgtttcagggaaaatatgttgagtggatagcaacaaaacgcatagaggggacagggaaatctttgccccagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacaggattatggtaatgcataaatttggagggatttttacttaaatcaatgacgtagttacctagggaagacaaagatgtgttcagtccctgaagcatccacttctgcaggcagatagtttacctgttactgacaggagtgtattttcataattctatcataatctataagagtagagtgagggagaaggcagctcccatcactgggtgccgaccgcgtcccaggcacttgctggatgcctcagagacttgatgaagaaaattagtcttttgttttgttttgttttgttttgagatggagtcgtgctctgttgcccaggctggagtgcagtggcgccatcttggctcaccgtaacctctgctcactgcagcctccaccttccagtttcaagagattctcctgcctaagcctcccgagtagctgggattacaggcgcccaccaccatgcctggctaatttttgtatttttcgtagagatggggtttcaccatgttggccaggctgatctcgaactcctgacctcaggtgagcaccttggcctcccaaagtgctgggattacaggcatgagccaccatggctggcccaattagtcttcttcaagatgaatttcactcacaagctcaaatagggagttgaaaaactgcatttgtgatatcacctccatcacttcgggctactcaagagtcagtgtgtaaaaatcgtccctttcatgaccactggctgtaacctaagttcctgtgctcaacaaggcagagaggatgtgtgtttggaaagctttcaacatcagatgtctggctcatcttacgatgtgtgttacagaatatcagctgcatccagtgtccccagacgagaatacaagccaaggcctgtgaaaaggagttctagtgagctcaatggagtttccaccacctctgtagtgaagacgacaggtaagttgaccattctaatatgctaagtgtgcctttagtaaagcacttctagaaacacttatttactgcttgtttctgggtcagtgaatacacacagaccctggatatctttctttggttgtttggtaaattcccttttcccctaaacgtgccccttttttctgttccctggggaagaattctatcacttatataatgtagcatttagaaccttggccatagaaccattatggctacatcatcctttatttttttaactctttgaaaatattttcttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacttaaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctgggattataggcatgagccactgtacccagccttttttctgttttttaaatgcgagattatactaggcatattgtttggcagtttgctttttaaaatgtatcactgtttcttcgagttatttccatatcatgcatatagatctatcccactgttttaacagcttcatagttttctattataccatttccctattggtggacgttaaggttttttccagttatttgctacagtgagtatcctttatcactgtgctggctacattactattaaagcatgaacacctgcttccccacacccatgccagtagacttccatttctgccaagcactcatgagaaaaaaatggtatccagtcttaatttgcattttcatgattattagtgagggtgaactttcttttctatattttaatttgtatttccttatgtctgaattgtctgtttatgtcatttatttgtgttttttgggagtagtttgctttgtcttattgttttataggagctctttccatatgaggatattaataatttttttcctagtttgtcatttatctttaaactttgtttttggagtgccttgtccctttgttgtttttgctgttgtttgctttgtttagttttgctttgagtatacagaagcttttattttgatgtagtcaaatgtatctgtcttttgcttatgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagctgcacagtgtgaattttcttccaaccttatggctatccttaaaggttttttttttttcatttaaaaacaaaaattatcagagtaatatgtgtatgtagtttaaaaagaaaatggtaatatacgtatgtggttttaaaaaggcaaatgtagttacctctacctctgtgtgaaaacatgggcaggccccatgaattttctcattattaaaactacaaattatcagagtatatgtgtatacatttttttattttttattttatttatttttatttttttgagacaaagtctcgctctgtcacccaggctggagtgcagtggcgccatctcggctcactgcaagctccgcctcctgggttcaggccattctcctgcctcggccccccgagtagctgagactacaggcgcccgataccgtgcctggctaattttttgtatttttaatagggacggggtttcactgcggtgttgatctcctgaccttgtgatccgcccgccttggcctcccaaagtgctgggattacagctgtgagccaccaggccgggccatgtgtatacatttttaaaaaaaacatggtgcaagctttttcgtgagaaaaggcagtttccccatcaactcctttcccagggcttattttttgttctcagaggaaacactttcaactcttttacatatttatttggtacttaacttcatggtgcttgttttttactatttctttttttactctgattcttcagtttggataaatgtattgatttcctgatatggaagataatggcttagcttcctaacccttggtcttccatagacttctccctcccttcacccttccaatttacttataatcactatttttgttaaataaatattcattgtgtaatcatcacttccatcatgtgggactcttaaaatgcactcctccccttttttccctgctcttattttaaattgcctactcacggatgaaaatgtgagcaggctgcatgacttttctgactactcttgggtcacataagttctccagtcacttgaatgtgtaagtgcaggctcgtgcagtagtcaaaatgctaagacccatgtcatatggtcaaagctataatcttgatttaaagtttggctttcactcctccccaagctctggcctgttgccgtgggaacattggtgtcagggaagaggttgtatttggctttttctctttccccatctaccccttctgttcttaagtccccagagaatgtattttaagctcgctgaggaatcttttaaaagttcttctctcttgatttggtgtgaaatgaaaagatcacaacacatcctgcctcctccacactctctccaacatttttctaaaaatcctttttaatctccatcttctgacctatttatgccatagatgtaggctgggattaaaagttataaaactggctaccctcatctcttctgtttttgtttgtttccaaatcctgcataagttgtcttctgcacatcggtttaataaaaaagaacaaacaaaaaaaaacagttctggggcctcatccaaaacttccatttttacatcgcctaacacttatttacaatgtcatgagcacagaaataatattcacagcagtatcacatagtgcactatcattgcatttctattcttgtacaattgttgtcttgatgactgtagctttataagttttgaggtcaggccctgttagtcctctaactttggtcttcattttaaaagttgtttgactattctagttactttgcattttcatgtgagttttagagatcaaattttcaatgtttcaaaaaaatcctgctcagatttttatttggattgggttgaatctataactcaatttaagaggaattgatagcttaacaatattgagtgttccaggcttgaacacaatctattgtatttcccatttatttaggtcttcttgaatttctctcagcagtgtttcactatttttagaatatatacaggtcttttaaattttttcatcaatctctaagtattttatatctttatgcaattgcaaacagcattttaataaaatttccatttctgaatttttgtttctagcattcataatattccattgatttttgtatattgatcttgtatcctgccatgttgctaaatttacatcttaggtctagtagttttttaatagattccatagtttttctacatagatgttcacgtcatctataaatgaagacagttttactcaatatctgcatgcctttgtttttcttgccttttttcacttgctagaacatgctgagtacaaagggttagagtggacatccttgctttgtctctgattttaggggagaagcattcaatacttcataattaaggatgattttagctgtagatttttcatagattttttttttttctttttgagacagggtcttgccctgttgcccaggctggagtgcagtggcgcagtcgcagcttgttgcaacctcaacctgccaggctcaaaagatcctcccacgttagcctcccacatagctgggactataggcacacaccaccaagcctggctaatttttgtatctttcgtagagatgaggattcaccctgttgcctaagctggtcatgaacttctgggctcaagctattcgcctgcttcggccttccaaagtgttgggattacaggcatgagccactaggcctggccttcatagattttaaaaatcagattgagagagttcccttctagtcataaatagtttgaagagagttttaatgagaaacagtctttgaattttgtcagatgcctttttttggtatctgttgagatgatcgtttattttttagttttagtttgttaatatggtgaattacattgttagttaaatcaaccttgcatccctaggataaactctttgtgggaaagtttttttaaattaattttaaattttagaatagttttagacttacagaaaagttgtgacgatagcacagggcattcccatatactcctccactcttctatattaacattttattagtatggcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgagaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcagtttctcacacaacttaaagcagaactatcatttgacccagcattcccgttactgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgttttttttttttttcctgcatgaaggctttaaactataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatttccacatatgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagagggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccactgatttatttatttattttttttactatcttaaatatccttctcctctattccctttctttttgcccttgtaaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccagacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatcttggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtctactttatgaagttgtttctcatacattgatgattcttggctctgtgcacaactttttatttgagagtgcttatgaggttgcctcctgtggttaaggggaaataagggatgttctgttgagtgcagtggactggtttctgtttttctgattgtttctatcatccatggcactgccctgactttctgtttcagatgcccacactcactcagtaccccttcctgaaggcagttgccagggctcctggcactggtacaaacccaggatgagtggactcacctggctgctcttttctcagaaagccagccagctttcaggatccacttacactgagttttgagcgcccttagacttcactgtcacagcattccgctttgggagccattttgaacctcatttcctccatctgctgctttccatcttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtattctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattccacccaggttgctgcagatgccattagttcatttctttttatggttgagtagtattctaccacatatatataccacagtttttttatccactcattgatgggcatttgggctggtcccatatttttgcaattgcaaattttgctgctataaacatgcgtgtgcaagtatcttttttgtataatgacttctttttcctctgggtagatacccagtagtgggattgctggatcaatggtagttccacttttagttctttaaggaatctccacacagttttccatagtggttgtactagtttacattcttaccagcagtgtagaaatgttcccttttcacccatccacgccaacatctattttttttaatattttgattattgccattcttgcaggggtaagttgatatcgcattgtggttttgatttgcatttcccggatcattagtgatgttgagcatttttttcatgtttgttggccatttgtatatcttcttttgagaattgtctattcatgtcgttagcccacttttagatgggattgtttgtttttttcttgctaagttgtttgagttccttgtagattctggatattagtcctttgtcagatgtatagattgtgaagattttctcccactctgtgggttgtctgtacactctgactgttccttttgctctgcaaaagctctttagtttaattaagtcccagctatttatctttatttttgttccatttgcttttgggttcttggtcatgaagtctttgcctaagccaatgtctagaagagtttttccaatgttatcttctagaatttttatagtttcaggtcttagatttaagtccttgatccacgttgagttgatttttgtataaggtgagagatgaggatccagtttcattctcctacacatagcttgccaattatcccaacaccatttgttgaatagggtgtcctttccccactttatgctttcgtttgctttgtcgaagatcagttggctgtacgtatttggctttatttctgggttctctgttctgttccattggtctatgtgcctatttttataacagtaccatgctgttttggtgactgtggccttatagtatagtttgaaatcaggtaatgtgatgcctccagatttgttctttttggttagttttgctttggctatgtgggctcttttttggtttcatatgaattttaggattgttttttctagttttgtgaagaatgatggtggtattttgatgatgggaattgcactgaatttgtagactgcttttggcagtatggttatcttcacaatattgattctgcccatccaagagcatgggatgtgtttccatttgtttgtgacatctgtgatttctttcagcagtattttgtagttttccttgtagaggtcttttacctttttggttaggtatatttctaagtttttgttttgcagctattataaaaggggttgagttcttgatttgattctcagcttggtctctgttggtatatagcagagctactgatttatgtacattaattttgtatcctgaaactttgctgaattcatttatcagttctaggagctttttggaggagtctttagggttctagggttttctaggtatacaattatatcatcagcaaacagtgacagtttgacttcctctataccgatttggatgccctttatttctttctcttgtctgattgctttggctagaacttccagtactatattgaatagaagtggtgagagtgggcatccttgtcttgttccagttctcagcggaaatgctttcaacttttgtcgattcagtattatgttggctgtgggtttttcatagatggtttttattacattgaggtatgtcccttgtatgccgattttgctgagggttttaatcacgaagggatgctggattctgcaaatgctttttctgtgtctattgagatgatcgtgtaatttttgtttttaattctgtttatgtggtgtatcacatatattgacttgcgtatgttaaaccatccctgcatccctggtataaaacccacttgattgtggtggattatctttttgatatgctattggattcatttagctagtatattgtcaaggatttttgcatctatgttcatcagggatattggtctgtagttttcttttttttctatgtcccttcctggttttggtattaaggtgatactgacttcatagaatgatttagggaggattccctctttctgtatcttgtagaatagtgtcaataggattggtaccgattcttctttgaatgtctgatagaattcagctgtgaatccatgtggtcctggacttttttttttttggtaattttaaaattaccatttcagtcttgctgcttgttattggtctgttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgtaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctcccacaggtcccttttataagggcacaaatcctactcatgacctaattacccccaagtcactaattctcatgacctaatcacctcctaaaggtcccagcccttaatactattgcattggagattaagtttcaacagatgagttttgggggaacacacacattcaggccatagcaaataggaaatacactgcatgtaccagtccataacaatgatggactcctgctgggcagaaatttcaaggaccccctaccctggcagtgaagaaagtgtcttgattagaccctggttctgctctctggattttggatcagggagactcttttgtcttttattctgtgggctcctagatttgctctctgagaaatgtgtcttccaagaccacattgtaagtgggctttggagggctaccttctttgacatctgtacttattgctgctcagggaccttgtgggttccttacagtttagtagacacagatgtcttcaggctaggcttatgcttcttttcacaacttgatttccttttttttttgagatagtcttgccctgttgcccaggctggagtgcagtggtgggatctcggcccactgcaacctccgcttcccaggttcaagcaattcttgtgcctcactctcctaagtagctgagattataggcatgcaccaccacgcctggccaatttttgtatttttagtagagatggggcttcaccatgttggccaggctggtcttgaactcctgaccttgagtgatccacctgcctcagcctcccaaactgctgtcaccacactggccacaacttgatttcttaaaaaacgtaatgagcttctgatctatatacctccaggcagttccatgtgcctgtaaacacattcaaagttctttcttagatatagctcttaagactttcatttctttccttccttgtcttacccatgcttcgctttcttaacttacagaggctaccttgagaccacctgaaacagcagatttgagtaggaaggtgacacctttcgttgcgtctttgccacacagctgagttcctttagtttagggaggtctctgagaatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggcttacgcctgtaatcccagcactttgggaggccgaggcgggtggatcacctgagttcaggagtttgagaccagcctgaccaacatggagaaaccccatctctactaaaaatacaaaattagctgggcatggtggcgcatgcctgtaatcctagctacttgggaggctgaggcaggagaatcccttgaaacccgggaggcagaggttgcggtgaggttgtggtgagccgagatcgcaccattgcactccaggctgggcaacaagagtgaaactctgtctaaaaagaaaaaaaaaaagaagctaggtataagcaaattaactaaaaattttgacagtgagttcaacctcagcctccctccttcaatgccagtatattatatttgaggaaatgagaacccaggaccccagggctcagtccttgccccactgtctctatctttccagcttgcacccgagtagttcttagagacaggacctcaggtcaagctcccaagacaccattctctcatttgccaccaaagagaactcaactttcctttgatttgagctcacagactggcagtgtagagagtgttaagccttataaaaatgaaaaggtatttgaattaaagtatcccttaaggtcatagggacctagcctttgagggccaacagtatgccaggagttattatttggtgctttgtagacatagacataactcatttcatcctcataaccgtactccaaggaagtgataataaaaaaaagtaacaaataataagataatgacaatagcaactacacttattggctacttactatgggttagatattgtataaatactttgtatacatctctagtactatttttagtccccattttacagatgagtaagtagaggctctgagaggttaagtgagatcttctcaagatcacagagccaggaagtagcagagctgggtactttaccttatagatatttcatgttatatcattaagaaggaatactaggggaatgttatgaaatggccaagagcattgggaatgatttatttccaagattcatgattacagggaatctgtggtcagcaggtggttgcacagggagcccactaaatgcatctgacttggaagggaaaaacagaggacagtgaggtctttggcttcctcattgaggccacgcatgtcagtgctttgtcccctctttcttggccagtagctgggtccctagacagattaagttcctagaagggcgatgtacagagatcacagacgtgcagaagctggcttttaagaaggctcagtgtcccatattctccactgcagcaaactctactgtgtgccactgtgtgtcttttgcctgtgcctgtcccaggctgcttcttctaagtttccctcggtagtagcttcaagttcccgtctcacacacccagcattgggcttccttgatttgtgggtggaatttgccagtgtaaagggggtcctgtactgtttgtttctgaggcacagtttcaaaagaaaatgacatttatagcctgcattaatgggaaattactttccattaggattctgaatgatttgcacataatgtttataaagtgaaggaaaaatgtcaagcatttcactaacaaatgaaagcaaagctcatgagactctgccagaaatgaattccaagaacattttcttcatcatttcttctttctaaagaaaaaaagagagagatgaaagaacataagtcaattaagcagaatgcatcgtgggactgagatggaatctttgataatatcattgctaggtagttaagagaatgaataaagtgagccaaaatggagaaaggggagaatcacatcttgaaatgacagattgcagacaaaatccaactctaggtcctggctgggagaaacgagtgcctgtccaagcccgcgagtgtggggtcatgctgtttcatcagtgtaagctgcccctctgtccccaaagagaaaaggaggccaggaaacatccttgagttgaaacatgtgcctgtgtagctcccagaaaaccactgatgttgaagaaaatagtgtaggaatttgtgacccatgctcaagtatcttccccacttgtggggaatttgtatcaggtcccaggttgtcacctcctgaattatatatttaaagactagaggacaaagtgtattttatcaactcattttttatgaagtttttttttttcttgctgaaactcttaaaaggggtaccactttgtgtaatcacaactaagggttaatatgccccaaactgggacctgctttaaacatataggaggctgaaattagttaacaaatatgtattccaaatgtgtgctacaggcacatcagagtgagttgaaataaatctcccaaatggcttgtattaagaccttctaattctctaggtataaaagagacttttataaatttcttcacacttctaaggcagcttggaaataatttctagagcctaaatccttcccctcattggcacaaaatgtctaggattacattagaaaataaacatttattcaaaagtgaaatgtgaagtttgaaaattaaagatgaacactttgcaaatagaaatatatgcaatttttttaacctacatttccgaagaggaaattaaaatttcacagaacagtgacaatggtgattgttcggtcagcaggttgtttcttacatttctcttctttccttcctcctcttttcttctattccccttctccactaatagccttccccccagatccatttctatatattataagtagtgcttcagagtcagagttattgacaagagagaaataaataaggaaacaagagtcccatgttatagttcagattctggaacttcttagttgtatgagttggggtgagtttcttagcacctctagaccgatttgaacttgttcctagaggaagtgattggacttaatacattccaaggtactttctagctctaaattctgtggctgtagtagttgtcttttgtgagtacttagcattcttaataatttgaaatgtggacaggttgaacatttaaatattttctatattttaaaaaatgttttaaaaattaaagtgtgaaatatgattattattgttgatcagtagccattggtgcggtgaacaggaagagtctctctcttattttccaatttgaaggaagatttagagagggaagttttcctcactgcagggaatggttttctgtaattattctgaacagtctgtaaaaagagttttgaaaagccgtaagacataaattctaacttagttgtgggaattttgactttgctgaaatgatctcaagtgctgcatattttcaaatcttaacatatactctataatgatacatttgatccataagctaaaatgtaaaataccatcatctaaatattaatttatgtacttgttttaaaaaatacggtagaagtcagttgtttcctgggattacaaaccaggcaacagtgatgttgcaccatccagaggactctgagtccatatgaatgacagcccctagagttgtccagtggatgtggctgcaagtgcaaacttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaatttcaataaatcacatctcctgtggataaatacagggctgttatttctagaaagacagcagttcattgacttttactagattttacttagtagtgcacaacttaaccctcatagaccaacacttcaaatttccagataaggaaatcaggacccaaagatgacctaatccatagcaaagatgcagggatctgaagcttctgtccagtgcgctcttacccatggacaaaaacaatatgttagagatgttgaactagatagtgtctgtggtatctatcagcattagacaccagtgttgtatctgggtcagatagagagaaagtatgtgcttcaaatgaattctgctataagaatttgagattataaatgggaaaaaagaaacttttgaagggagtttaaaccagatatgcttgtttgaactcagaggagatggtatctcacagattgagcacggtgcctggctccatgctcctggctccatgctttcaaacactcggtgagagtttgaaaatgaattggaaccagaaataaacctgaaagttccaaattgggtttctacccgccccccactccccccgcccgcccatggtaggagatgaactgtctagtctgatggtgcaggtacagtcaaacctcagggtaacctgggttctgggatcgaagcttctaggagacttggggtcccattcctgactggggcatggactcccctcatcaatggttaccttcctctctgttcatcagctgctctacaagtggtgtaagtaataagggaacatgtttggatttcctgacttcaggccaggaagtgagcggaatataagcccacccagcccaaaggggtgttaacctgccttgctggaaagtgggctttggagtcagagggaagcccagatcctggctcagttcatacctttgggtctcaatttcgtcatctgacgagtgcggattctcattgctacctcacaggattattctaaggattaaattagatcttgtgaattaggggtgctgggaaagggactcggtacagagtaggagcccacaatgcagcgctgttaatgttacataatcggttatctgatttcccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacatagtgagaccccacctctatagaaaataccaaaattatccgggcatgatggtgcctgtagtcccaggtactcaggaggctaaggtggaaggattgcttgagcccaggaggtcaaggctgcaggccaatagcagggcactgtactgcagctcgaggaacagagcaagacagtctcaaaaaagaaaaaaggaaaaggaaaagagaaaagaaagaaaaagaaaaagagtggggataagaccacaaactaacaattttcagggggtatattgcatagggatcaagaacgtggactctctacctggcccgaggtcaagtctcagtgttgtggcttaattgtgttaaatttgtgtcctcaatttctccatccctcacattgggggaaatagtggtacctactcataggatttctctgggaattaaatccataaatccactaatatctctgagacacttaaaatattgtcctggcacatggtaaacactaacacctgagagttattatttcgtccctgtagctgagtagggctgaggaattgtaggattggaccgcctctaccttaataaaatgtgctcagcatttctgcatatgcaagtaaccctttgcagcagcagggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggtgccagctactgaatgtgagagagcaaggaggtggaggtggatgaggaactgccagctgcaggaccacaggggcaaggggaaggggttgtcaacagggatgggacgctgggtaggatcagtcttttcttacgagacgttttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccactgggctccagcccccgtgttagtccagagaactttgacagctgccttctcccgggatttctgtggaaagtggagtctaagacccccttccccagggtggcatccaaggagcatttcaattttcttgctcaccctcttctcactgcaggccccttccctgcttccctgcctccaggaagagcttgtatctcttctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttgtgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagcaaggtagctgatggcctagggtctggagccctcctgtttctggctcagccagtagccctggggccaggccattatgacctctcagaggcattgatggcttctcttggaaaaggagaggactcatggaggactgccaaattccattctagcattaacattctgtgttcaaggaaatgcttcccgagactaccatgtggtttggcacctgaccccttctctgttaaaaactagtctagtagtgggagaaatgctaaaagaataataattatttttataatccacattaaaacagttatacattaataaagtagactttgactcacagctcaggttgcccttggttttcagtgctcagcccccacctgcccacccatatacacactccatgacccaaggaaaatgaaaagttctgtattgtaagccctctattccccatgctttgtttgaaatcattgaatgttgttctgttcaaattcaaaatagtgaactaatccccaatatttacagccttccaccccctagctttcatcattatgacaagaggaatacacagacttaggcaggggtggggtctgtcacggaaggagctgtctagaggctagaaacatcatgtagatcatagaggttatattgcaggtgggttcagagtttcaaagtcacgacccagtacaggagctgcctccctgaagaggaagaagagctcccctaccattacccccttctctttcctcgccagctgagtctctttaacctttaacgcttccttaggggaaggagaggggaggatcatttcactggtggttgtcaacctaccctggacataggaaggacctgagaaacaaaaaatactgatgccgggttcaccctgggcagtgggctgtttagtgtgccaccaagttgagaaccactgccataggaaggcaacaggaagccaccttggtacaacctggggagctccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtacctattctctttacttggacctagaagacttagtggagaaagaacataatctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgaactagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatgactgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttgggaataatgtttgtaccagaaatgacagataaagggtaaatatgtgtagtataaagggacttctaaacatcttaagaaaaatagtgatattaggttggtgcaaaagtaattgcaggttttgccactaaaagtaatggtaaaaattgtgattgctttttttttttttttttttgagatggagtcttgctctgtcccccaggctggagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatattttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattagttgaagaaatgttacattgtgagagctgacagctagtcagtaactaaaattgaaagatattcaccctagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctcccggcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttgggaggctgaggcacgaaaatttcttgaacctgggaggcagaggttacagtaagccaggatcgcaccattgcactccagcctgggcaacagagcaagactctgtctcaaaaatagataaataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggccttggttatttttaatgttgaattgttgatttttaagcacagtcttccagctgcaaactcacaccccatggccaaccgaagtgtcacagcgcagatgcttagatgatgcctcctgatgggagccttcgctttccacctgattcaaacatgacacgaatcctccttccagctgggggatggaaagcccttctacttaccttcaagtttatttataaaagaccccaaatcaagcttctgctgctgccatattttggataggtttttcagaaagttgtgttatgggtgctcaggaagtagtgtggtcaagagttgattgagtccccaataacatcctcttaggctcagtgaaccagcccctggccttgcctacagtacgcactagttacatgctttggcccactggagtctacaatcctattatgtgaaggggcaggtattatttcccatttgaaaagaaggagcctcattgactgacttacctaggatcaaacgaccacatacagacacacctcagagatattgcaggttctgttcctggctacttactgcaataaagcaaatattgcaataaaacaagtcacacaaattctgggggtttcccagtgtatagaaaagttgtgcttacacatagacacgaggaggggaacaacacacactggggcctgttgctgggggaggggaggagggagagcatcaggaacatagctaatgcgtgtcgggcttaatacctaggcgatgggttggtaggtcaaaccaaatccaaatggcacacatttccctatgaaacaaacctgcacatcctgcacatgtaccctggtacttaagaagagttgtgtttacactatgctgtagtctattaaatgggtaggagcatatgtcttaaaaaaacaaactacacaccttaatttaaaatactttactactaaaaaatgctaatgattatctgagccttcagcaaggggtaatatttttgctgctggaagttcttgatattgatagccactgactgatcagggtggggttgctgaaggttggggtgtctgtggcaatttcttaaaataagacaacactgaagtttgctgtatgggttgactcttcctttcacaaaagatttctctgtcacatgcaatgctgcttgatagcattttacacacagaacttctttcaaaatttgagtcagtcctctcatcctaccactgctttatcaagtttatgtaatattctaaatcctttgttgccattacaataatgttcacagcatcttcaccaagagtagattctatctcaagaaatcattttctttgttcaactgtaagaagcaattcctcatctattcaagcttttttacgagattgcaggaattcagtcacatcttcagtctccacttctaattctagttctcctgttatttccaccacatctgcaattactttctccactgaagtcttaagcccttcaaagtcatccaagagggttgaaatcaacttattctaaactcctgttaatgttgatattttgacttcctcccatgaatcacaaatgttcttaaaggcatctagaatactgagtcctttccagaaggttttcactttactttgcccagatccatcaatagaatcactagttatggtagctgtagccttacaagatgtatttcttgagtaatagacttgaaaatagaaattacttcttgatccatgggctgaagaatggatgttatgttagtaggcatgaaaacaacattcatctccttgcatatctctatcagagctcctggatgacaaggtgcattgttagcagagatattgtgaaaggaatctttttctctgaacggtagatctcaacagtaggcttaaaatatttagtaagccatgctataaacagacatactgtcatccaggctttgttccatttatagagcacaagcagagcagatttagcatcattcttaaggaccctaaaatttttggaatggtcagtgcgcattggcttc

SEQ ID NO: 14354 - DNA, 10494 bp, Human
taatttagttcttttcaaagaagaaattatagactagcttattttaataacccagtccaaattataaaaagaaaagctttaccagcctaatctctggtatagagaatgttctctttttttagttgacattggggggagaaaagcttgactttgaagttcagcaagtctggtttcaaccccagccacaactgggtgaactttgtcaaattacttaaacagtcttatccttgggtttttatttgtaactataaaatttgagtgatgttaatgataagtaccacagagtattgtactttgaatgaaaggtcttaattgtcaaatgaacaactgaattattttataggaagagttcaactttaataaatactcctgcagaatttcatcattatgatgttaaaattgatggaagctttattttttaaactgagaaactaatgcttacgtggcctagtttaagaatgaatgctccaacttaatacatgttttaaaaagatgttttgggataccaaatgtaaaagaattccgagtttgtgttattttattgaacaaacctattcagcacttggggaatcgcaggcagcattgcagactcgctggctcctggctgtgatctcacacccaaactgcaataatatcctgataaaacggacttccacaagtaggtcaagaataataatgtgcagacctaattcctctaatttacggcgaacatctcatggtcaatctccccgcggtcaaaggactgtgtatctcttcctctcagagccactccacaggctgaaaggctgactaaacccctgacagataagagattcaagagtagtcccagcccccatggggagcaaagacgctggctcaaaaaacgtactgataactctcccttttgcagctactcctttctgaaccttccacaagcagtggcagttggattctgtgattagtctagtcttcagagccagccttcttgagttcaaattctgacttcaccccttaatgtgaagtgacatgggcaagttgcttaatctctctgtgcctcagtgtccttgtctgtaaaatgggcatcataataatagcgcctgccacattgggtgagtgtgagaatgaaggaattaatacatgtaaatcacttagactgtgtctggcatagaggacattctaaagaaaagttagctattatcattatattattatatgggtctggaattagttcctgaatccttctgagatgtgatgacttataaacgtaggttgagtttactcatgatagggtcatcgcaactatgcatagctaaaatcaaattttgcttttcaagtttgttttacctggagccctagagttcagggttatggtttcctttgtcactccccttgagggaagcttcttagtcacactctccttctctttctctgcactctatgcactctagaaaagctcctttttttttttcttcatccaggcagagaggcctactgggacttaaatccaaggagctgaaatctgttttgggatggggtggagtcacattctggaacctagacagagaatttctaagttccagaaagtgctgcttacttcgcatttcctctcccccacctttgcttttgaaactcctggcaccaatgctgccaaggctggcggagctttcctgagtggtgtctgccaaatgaggagtcaaggaatatctggaaaggcagcctccaggtccccgatgtcaagaccatttagaactgaaagtgtcccaatatcggggtacaggcaataagcattagttattaatcagcctgagaagttgattctaaaataggaggaaatgattcaattatttcctctcaagggattactcaatgttgtttttatgtttaaatatttatttgtcaacatcaagaattcttagtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttgggtaagcatcaattacttatctaaaatttgtaataagaaaagtcttcataattcatgattgtgtttatctttatgttagtaaatttctatgttggttctattcttccccttatattttaagaaaagaagtaagaaagtaaatgattatttttctgaaagaaaaaattaatgtatttattattattcatagaccttcaactactcttagaaagcctttggtgactcctgggaacaagctgagtcaggaacaaaagtttgagggtttggggttgagaataggacaattacttggctaatgctttagtctagttctgattttgctactccttagttgctttgtgatgactacttgcacatgtgtctgtttgtgagttatttttgtgagcatgctgctaccagcctgtgtggatgtctgtggtttcacatgatacattttattttctaaagtctactgaattttatggtttttttttcaaaaatagaaactcatattctttccttcttaatttagtttctttcaggacattctcatgagactggtgaaatataactgcgaagtagcatgataactgtgaaatagcatgatcattgtgaaagctatatgacccaaaacttccataggaataagtgcaatgcttgcatatctgaaacctgctgttacatctctttgcacttaataaatatgtgttgactgattcattctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaagtattgccttctaagtataatttaaatttttataaattaaataatttcaagaacatttaccttgttttaagcagtttgcttccagttgttccagttgaattgtaaactgaaaaatatattgcttttgtacaatcatttttcattacaaatctatcagaagaaattctttgtaatgaatatatcatcagtttggctttgcatattcaaatgcagcagaatttaatgtggtgcctgcacatgggaagtgttgtggatgtttattgactgacacacagtttgtttagatagataaggctgcttttccattggataactgtgggggatttagctccaaattaattcattaacatttcataagagatcttaacagttacttattctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagggggcctctagtaggtgaaaaggggcttctaaccttcaagttaagccacagaaggctgatgagattgtgtgcctaaaaattaattacttttgttcacaaattgttaaatgttttgattttgtggctgtatttggcacacacaaaatgtcaaatgaattaaatcaaaaagcaggatgtattagttaagggcctaggtctgagactagacaagtgtcaaattcatgctctgccactagttaactgtgcgatgccagcaagttacttctctgcccttcagtttccttctctgtaaaatgcatataatgtaataatatatttcatctcaaagcattattgtgaaaataaactaaggtaatgtgtgaaaagtgctcatcatcatcactggtacagagtaaactctgaataaatagtaattatctttattacactgggattacagcattacagcagatgtagtgtatgaataaatggtgaagaagtcattgttagggctactatgggggctatgtttttagctcaagtgtaacaaaaaagtatttaaactctagattttaatgtttatttttaaataataaaataaccattatgtatattgatggtttttaagaagaaaagcaatattaagtaaaggctgaatttagattaagttatttcacaatgctaagtgactcttttaattgtctgacttattttaacagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaaggtaagaagaaatttggaaggaaatagatgaaaattacacaattaaaatagacacaagtggccgggcacagtggctcatgcctgtaatcctagcactttgggaggccaaggcaggcagatcacttgaggccaggagtttgagaccagcctggccaacatgaggaaaccccatctctactaaaaatataaaaatcagctgggtgtggtggcacacacctgtaatcccagcagcttgggaggctgaggtatgaaaatcacttgaacctagaaggcagaggttacagcgagcccagattgcaccactcactccagcctaggcaacaaacattctgtcaacagataaataaataaaagtgaagaattactgagaaggaaatggaatttcttatttcagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaagggtgagctactgacattaatgagatagaatactacgtgaaagaagtcgaagtgggaacagcggtgcccttctggttgggtttcttgcacttctccctcctccctttacttcctcctgctccatcttatcttatacattctgaactatgacgcaaagaggttttctgaacacactatcaagatttaagaaatttcagggggaaattacattactaattcaaagccacatctgttctttattctttttttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaagtttaatgagaggctttgtgatggtatactatggtgtacataaatgttgtcgagtggtttttaatctttgtttgcaatactttcaacatcatcaatggccttgagtaagtcacttcattctaaaaatgtgttttccaagttattttaaattttataaaagcttatttaagggaaagatttcacaatcatagcttatcaatctacaaaggattggggtctccttagcacaagtcgatctacagacgtagatgtaatagcccctttacgtatgacagttttttcagggcaaagcaatattggagacaaatttttggagtttttcaatactccaccgctgtaaaataagcatcaccagaccacattcctatcagtgcctctttctgtttaatatcaacccttacagtggtccttaatcacactgtcattaaataaatgagcatgaagggatggaggattgcagcagtgctccataagcactgcccgtctttcagccttagtggtcacaggagtcagaattccgtacggggaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcgtgtgtgtgtgtgtgtgtgtgtgtgtgtgtgtttgtcattatgggttattgtcagaagaacttgaaaaacattgctatgaaatagaatagaaacatgaaaatacaagctttatattgactagcattcaatgctctcctaatatttatatttctttttgtctttaagatgagcaaggcttttctctgtttccagtaatcggagcccctgcacaaaatgaaataaaggaagtggaaattggtaagaaaatttatcagaatgctgtaaatattgcctggaaaaatccttccatatgacccctgttctgaattcccttagcaggggtcaggcaattagcataaggaaccttgaggagtaagtgaggtgacatccctgaaagcacctgccccaagcatttgctaatattgggaacagggacacagcaattgcagtgtttacatttgtttattgtactttgtaattcatgatgctttcatgtatgcatctaatttcatcttcatctctatcccagagcttgggatggagacctgcagggtgttcattctgggcaatggtagccagatccagtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccatgcagatgagaatatagtgggagctgagcttcaaacccagctgggtgaatgaaggtaatggaagcagggaggaggcaagagaggacatagaaagaggaaggtgctagagatgagggagggaggtcctggtggggtgcatactaagtgttcagtaaggttttttttttacattaaatgggataaaatgccagtcgcagaagttaattttattggtgaatgtccttactcccctctaggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaaggtatttttatattgaagagaaccatcctcttccccttgcacatggtttgcacctgcaaagtaggcattaaaagtaacaggttgctttcttagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacggctctgcaggctgtatgggaagcatggcggcatctgcttctggggacacctcaggagctttactcatggcagaaggcaaagcaaaggcaggcacttcaaacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaacgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggt

SEQ ID NO: 14355 - DNA, 10494 bp, Human; identical to SEQ ID NO: 14354

SEQ ID NO: 14356 - DNA, 41617 bp, Human
atattacccagtcatatatgtatacacacacatagaaaattacacggcagattacttacagtagcgtgagagaatttttgagtgggtgggattctttacagcaagtttttttttttttgcttctttgaattttttttactcttttaggtttttatatttataaaagttatatttactttttaaaagtgtcaaccttaatattgagattcagaaatatgattacatatagtgtgtatttgagcacagagcctgagaatggccacctggacaaatggggtcagcctttccaagtggagctcaggtctctcttaccaggcggagacagaagctccagcaggatcaccacagttctcatatgagaccaggggcacacgccgcagcggttccattggttagggatctctgtatttgaaggaagattgcgttataactccatgaggaggggtagtgatctgagggggtcttatctccggtgccatttggtctttattgtttacagggaaaaaggcagaagttacagctgggtgtggcatgacctaggccgcgtagccacattcccctcaaggctcaggtaattcaaagttccaacagcttcaagtttaaattattttaagtttgaatgatttaatttcacaaaaggtaatatatgcacattgactgaaattcaaaagcacaaaaagatatccaaggaagtacctctcccacttctaccatctctcatcttccagcactccttccagaggccttgcgctatgccggttttctcatttttccttcctgggacagtttagggatttttctacctatcattaaattcgtattttactcaaatgcaggcatacgataaacacgatcctatacttgctttttcccacatactatatcttgaagatcgttcaatgtccatgcaaagctgactgttcttttgaacagccagcgagtattccattacgtgagcgtatcatgacctatttactcagttccatacttcatgggtgtttaaattgtctgcaatcttttgctattacaaacgaaaccacaggtcattttgcacacatgcaaaaatgcaaatccatggtatatttcccaaaataaaaatcattaggtttaacagcacgaacacctttaaatttggaagatattccaattcgttcatcctagagagtataccaataccactcacaaaacttgagggtgcctgcttcccgacattcctgctagcagtgtcatcaacctttgtgatctttgttaacatatgaaaagtggtactctaattttaatttttattatgaattaagttggactttctttcgtatgttaaagtctatttgcatttctttccctgtgaactgttttttgcctgtctttctcctgagccattggtctcttcccactgacttattacatatatgtaaagggaatattggctctacattataaggaaattcgaattttgtgataggtttcaaatttttccctaggttgtctttgacttcatttgctgtttgtgcacacaattttttttttttgtaatgagagtgcgttgctcttatttttaaaatgttgactacattctggggaaagaaggctcagcagccacctgcttttttgcccgggtgggtggtccggccccgagccctcctgactctctcgccaatgcccagaggcgccgcagcgattccagggaggccgcgctctcgccccaaggcaaccagaagcccacgtgccaggagaggcatcggaaccaacaactcgggtccgttttcccgcgccagatgggattcgtttgctgtggacttccggggcggggcctgcctggagcggaagagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccaggtgggcggccccgactcggggtgcggggcccaggcctcgccgggtctttttccgcgcggcgtggggctggggtgactgttgtcggggctcttggtggggaaggactgggccggccctgggccttcatctggggccagcagcgctgtctccgcctcgcccagaagggagcggtccctgcagctgggaggggcacagcccggggagtggaggcccccgagcgcacggggcgcctcagtcgggtctgagcctcgttctgcacctggcgcggaggaggtgcccaggaaacactgactactcagtgcaagttgaaggacaatttttggaggaaagttgcagggctagctaataaaacatttttgagaggtttagttgtaatttttactgggctgaatttaagtgaataaagatgtgaagaagcctgttgtctcaaatcaatactttaaaaattctcgttaactatgtctgtgttctctgcactacctttgaatagcagagagcgtttaaggcaagaagtgtcttcgagaatcagcagcatcagttttatctatattgttgtttattttttgttgaaatgcttgctctttcaggaaattggaaagaaagggaaagaaaagccatggtaatgcagagttttcggaattgggtgctaactgacgtggccaaatgtttgcagtccatttggagggctgtgtttttatttaccatgagtcagttgaattcagtgttttctgatcactttttcttcggtacggagacgtagtgaggaatatgacaggcccggtttccagccagagacaccggtattgagcatatttataactatcccgttggcattcctcctgcctcgggctagcagcagtggtcctggcttgtctccaggggaactgaggcagagactgtagaagactgaggactgaggagcagaacagggtctaaagctagccgtaggtcactgtgggtggccctcattgtcggctccttcatttttgttagacttggaggaggtgagttcttccccatgttcagtgaagcttagttaatttatgtgtgtgtgtttttaaacttgagtgttattaaaactgccactgtgttatataaggtatttgagtatagtgttctgtcttctaaatttcactttgggattcattaacagctcgttgaaagtgttatataaatcacacatgaattgttaatgactagcttttgctgtttcacttgcatttcacttgtatgtttcacgatacatttttacagtgtatgagttttaaaaaattaccttcataagttgcatatacaaagatattacaggaatgtttgtattgcgacactgaactaaaatttaccctacgtgagatgtaagatagagatgtaacaaattgttgtcttgagatgaagatttattacatagaattatattaatatattacatagaattataataatattagataactgtttaagactattaaaataacagggcagttaccacctttttttttttttggtatgcagcaacagtatcaaagtgctctattttgggcagataaagtagcttcactctctcgtggtaagtgacaaaatgctaactggttttctgattaatcttaaaattcgttttctatttcaccttgtacctctgaccacttatgtgaatttttccctccagaagaaccccaggacatctattggttggctcagtgtctttacctgacagcacaatatcacagagccgcccatgcacttcggtcacgaaaactggacaaagtaagtgatggtatgaactttaaagctcttcagagctttaaaaaaaatgtcattagtggccgggcgcggtggcttacacctgtaatcccagcgctttggaaagccaaggcaggtggatcatgaggtcaggagctcaagaccaagatggtgaaaccccatctccgctaaaaatacaaaaattagccggacgtggtggcaggcgcctgtaatcccagctactcgggaggctgaggcagagaattacttgaacctgggaggtggaggttgcagtgagctgagttcgtgcattgcactccagcctggacaacagagcaagactctgtctcaaaaaaaaaaaaaatcattgggttttaggtgtatattccatttctgttgaaattatttaaattgatgcaatttttctttgtttttgtttttttgaggtctctctgtgtcacccaggagtgcagtgggatgatcgtggctcactataacctcagactcctgagttcaagtgatccttctgcctcagcctccctaatagctgggactacaggtgcatgccaccacacccagctaatttttaaatttttttggtagagacagagcctcactatgttgcccaggctagtcttgaactcctggtctcaagcagtcctcccgccttggtctcccaaagtgctgggattatagatgtgagtcatcacagtaggcccagtttttttttagtgaaagtgaagggaaaatgtcttatacctaatctgtcaccttctttttcccccatctcccatctagtctctaaattctgaagactgttttctaaacagctctggaatcatggatattcctcttcctccccactcgtacgtgtcaggcctttgatttttttgtctgttctgttacagcctctcttcttgtctcttttccccagtaacagtttctctcttcttatcttccctgtcacaagttcatcttgtgaactattacaggagtgagtagtctttaaaacacggatgtggttatattcccacaaagtcattcagtgacttcccattagctgcaggataaagtcagatgcatcagtaggtctgtgaggccctccttgttttctctccactctgcgtctaatccaccaccatcaatacctggagcacgtgctccagtcacgtggtgctgctgtgagctccttggacacccagcagttattcacactcagggcctgaagtggagctgctgcgatctccttggacgcccagcagttattcacactcagtgcctgaagtggagctgctgtgagctcctcggacgcccagcagttattcacactgagggcctgaagtggagctgctgcgatctcctcggacgcccagcagttattcacactcagtgcctgaagtggagctgctgtgagctcctcggacgcccagcagttattcacactcagggcctgaagtggagctgctgcgatctcctcggatgcccagcagttattcacactcagtgcctgaagtggagctgctgcgagctcctcggacgcccagcagttattcacactcagggcctgaagtggagctgctgcgagctcctcggacgcccagcagttattcacactcagggcctgaagtggagctgctgcgatctcctcggacgcccagcagttattcacactcagtgcctgaagtggagctgctgcgatctccttggacccccagcagttattcacactcagtgcttgaagagctacccagtgctccactcctctgcctgaccacttactcgctgcctcacttactcgctctcctgcagatgtttacttctccacctggttgatgctttctgttgccccgtttcgtcatgcttacctgttgtgcttagttcacatctcccctactgtaacctcctggggcagggccttactgcttttgaatccttggtgcctagtaaacagtaggttcataataaatatggtttaacaggactggattttttttttaactgcaagagtaaaaggagaaattatgaaattagttctattttatgcttatggctttctttgaaagtgaagatacatattattttgaccactacttaaacaaattaatttctttcctagttgtatgaagcatgtcgttaccttgcagctaggtgccatgtaagtatgctcataatttcatttttatttggttgaataaaatgagtgttatgcatctcttaaatatgtgtgagaattttagtgatggagcttagcaggttagtaaagtatttcatgaggaagtgttcctttccttagtcatgtttgctataaaatactgattcttcgtttaccacatgctgacatgcatgaagaaaattctactttagacatttcacatttaaataatgggcatagtatatgttatcctttaaaaattcggatcatgtgtttcgtgttagaagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcagtaagtagtactgtgagcacagctcagtaacggcggcgagaattgccctcattacgtggcagaaacacattatcttcttttacttattactatattaaaacaattgtggttgccaatttatttaatttgcccaccaaaaccaaaaaagattctgagacatttctgagcccttagttgcaagctgtaattgtatccgcagatgcctgcatccaaaataggctggcttgaaacttccttctcatatttgatgccttaagctactccctaaaagtggaataatttttcttctcctttctgtgtttcagcagtgttttggacctacaccaagaaactttgattagcgtacattgtttctttccaggaaatggttttgtgttctgtttgcttcaaagtacattgctatgtaattgtgtatatttcagtttgtatacttcatatctccatgaaattgcacattccttgctggcagacatcatatagtaacttattaagtgacatttacagatcactaatctggatttaaaaaaaaaaataaaaacttattgaggtataatttatatgccatgcagttcccccatttaaactgtatggtttgattccttttagtgtattcacagagctttgcaaacctcaccatggtcaattttagaatatttttattattcagaaagaatccctgtaagccttacctgacctaccaatttctctttcttcccacatcttttttttttaaattaagacagggtctttgctttgttgtccaggctggagtgcagtggcacaatcacagctcactgcagcctcaacctcccaagctcaagtgattctcccacctcagcctcccgagtagctgggactacaggcgcccgccaccatgcccggctaattttttgctattttagtagagacggggtttcaccatgttagccaggatggtctcgatctcctgacctcgtggtttgcccacctcggcctcccaaagtgctgggattacaggtgtgagccactgtgcccggcacagttggctaaattttttaaaaaatgttttgtagagacagggtctcactgtgttgcccaggatggtctcaaactcctgggctcaagtgatcctcctgccttagtttcccaaagtgttgggattacagtcatgagccactgcacctggcccatttatttatatttttggtagaagtttattacttgacttttcaccttagatagttatttttaagcataaaagaatattacacattctaggtttttgtttttgtttttttttctggccactcattaatgtatgtgttgggaagcagattcttctgttaagaaatgcatttatgaaagtgtgtggtacagtcattattttgggacctcttatccattaacttatttgctatgaaatgtgtgatttatttgcaacgcattattatttattttgtgaaattacatttttaaaaaacaactcctaggatattgcttagttcgaagactctcataattcattattttttctaaaattttactttatgaatcttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggataggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgttataaagatgtgttggaacagagcagttgaagcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtggtattgtgcacctgtaatcctagctactcaggaggctgaggcaggagggtcatttgagatcataggagttcaaggctgcagtgagctatgatcgcaccactgaactccagcctgggagacagagtgagactctgcctctaaggagaaaaaaaaaaagttaagtttaaaagtactgacttaatatgtgactcatcatttttccaacagataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaaagctttcaaaaatacctttttcctctgaaagactccttatactaaaagattgaattaccaagtaaatgtaaatggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttattagtttggtgcaaaagtaattgcagtttttgctgttgaacgtagtggtaaaactgcagttatttttgcaccaacctaataggatttcctgttggttttgattcttttaaataagcggcctacttattttatgtattacaattctgttgacttaaagtaaatgtatgtgataatgtttatttttattcctttcaaataaaccagaattttttctttcatttgtaacttaattatggccttaactgaatcaacctgaagataatggagtgaagaaagtgaagtgttacaacccacagcatcatatgtgataccataatgactgtctacacatagccgatcgtcgtgagtgctgtcacctgctgttttgggggtagtaatgtgtcgctttaactttcagagtaatggagaaagatcctttccatgcaagttgtttacctgtacatatagggacgcttgtagagctgaataaagccaatggtaagacttttttttaaattaaagtaattcttagacataaaacaaatcttttctgtaacttgaaattttgtctctgaaattctggatagttgagattgcaggtaacaacataatggaaccctactataaaagtaacaactggggaggaaatgtttaggaaagtagcaaatggccaattttgttttcccatcagaacaattagttctttatcactgcttcctactaccttttctcaaatatcatttatgtttcaaggtttgttagctttaaattgttgggtgtcagttctgcctcccccccccttttttttttttgtaaattccactggaaatctgatatggtaagagttgataactacttagaaattggaaaggagcagattgtttgctcatgttttccgtatttttaacatttgacatttagttgtgtttggggatgcatttgtccttaaatttttctaaactgaatggtgagctctgtcaggaaggaaaaccctcaccgaatccctgctgctcagagtgtggttcgtggaccagcaacatcgcatttgtggaagctggttggaaatgcagcatctccagctgctctggtctactgaatccaagtctgcatgcaggaaacatcatcttgaaatgccaggatttacacatttctcaagattaaatagtatcattgatctgataaacttgaaagtttgttcagccaaattggttgtgggtgattatgatggtccataatgggcccttggtgtgacaggcatgagcttctaagagaggtgaggtgctttgctgtatcctctgcagtattcgggaagtgctgtcttagggggtgtctgttcccaccttgcccacagtgtgtccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgtctaccctaatttgttgcagattccaattagatattccaattccaatctttgtttatggtaaattttgaactttttaggtgtcttggtttgcagtgggatgttactatctcatggtcggtcataaaaatgaacatgccagaagatatctcaggtatgaatttatttttttcctctctagttaacctgtagaattgatgtcttgctcataagctttcaagtagtaattagtgagtactttaaaagcaatgtgaaagaataaatgtttttttttttcttcctttcttttctttctctctttctttcttgccttttcttttccttctcacctcccctcccctctctctcgagggttctcactctgttgcccagactagagtgcagtggtgcaataatagctcacctcaaactcaaatgatcctcttgctcagcctcccgagtagctgggactacaggcaccaccatgcctagctgatttaaacatttttttttttttttagtagagacgaatctcactgtgttgcctaggctggtcttgaactcctggcctcaagcagtcctcttgcttcggcctccgaaagtgttgagatgacaggcatgagccaccatgcctggctgaataaatgttttcttcaagtggtttgttctttataagatgccatggggagagagagaaaaaaaaaatcagtgatgtagaccctattctcagggaacctacatattttatttattaatgagaataaatggccaggcatggtggctcacacctgttatgccagcactttgggaggtcaatgcaggtggatcacctgaggtcaggagttcaagaccagcctgactaacatggtgaaactctgtctactaaaaatacaaaaaattagccagatatagtagtgggcatctgcatcccagctactcgggaggctgagacaggagaatcgcttgaacctggaaagtggaggttgcagtgagctgatatcgcaccattgcactccagtctgggtgacaagagcaaaactctgtctcaaaaaaataataataataattaataaatgagaataaatatgaaacaatagagaataatgtagtttgaaagtttctctctttcgcttacagagatcctgttaaccttttacttttaggatttcttttattaatagttgtgaaattacacaaaactttatgtaaaattggggtcactaaatgtgactataaaacagaattcttagcagggtgaactgattcatgtaatgatttgctgtggttttaacttaaggaaagccatgcagcctagtgaagctatttaaccagtattattcaagtttagaaaaatgtcaagtatgtgaagaattaattacttaaactctgtaaatgttctaatttctgtggtttcttccgtgcaaataaaacagaattggtctctaacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctgggcatggtggcatgcacctgtaatccccgctacttgggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaagatgattagtattgtaaaagttattttgagctatgctgctttgatctagcgtgcaattcagtgatggactcttatcagtggtccccaacatttttggcaccagggaccattttgtagaagccccccctcccagggtggggggactggtttcttgatgattcaagcgcattacatttatcgtgtgcttttttctattattattacattgtagcatataatgaaataattatacaactcactataatgaagaatcagtgggagccctgagcttgttttcctgcaactagatggtcccatctgggagagatgggagacagcgacaggtcatcaggcattagattctcgtaaggagtgcgccacctagatccctcacatgtgcagttaacaatagggtttgcgcacttacgagaacctaatgcctctgatctgacaggaggcagagctcaggcggaaatgcaagtgaaggggagtggctgtaaatacagattaagcttttttttttttcaaatggcaagttctttcttgacatatgaagctttactcacctgcctgccactcacctcctgctgtgccgcctggttcctaataggccagggactgataccagtctgtggcccaggggttgggacccctgctctacatgaaacaggtaacatttggataaaagaaaacttaaaatacaaggaagtagggtatcaccccctatgtcttccacgttttgtgatatgttctctttattccttgtgggttaattatacagtgttcactgtatacaattattcactgatatatatgagtccagtccctgtaaccagggtatatctgttgaccatcatctataggatatcgcctaatccctcaagccttggtatacctgtctttaaaatataaatgaatttatcttgcaagttattaggatgagaggatgtatctactaggttacaaaatggagctcctggattaagtaatatctgtaagttctatttagaatgctaatgggttttgctacagtgcataaaaagctgtggatctcctcaaatttcttaaaattttgctatactattaaacagttttagttcaaatgaatcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggaggccaaggtgggtggagcacctgaggtcaggagttcaagaccagcctgaccgacatggtgaaaccccatctctactgtgaatacaaaattagccgggcatggtggcgggtgcctgtaatcccagctactcgggaggttgaggtaggagaattgcttggtatctggaggcggaggctgcagagagccgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttacttcacagcagcacagctgatgaaagggtacggcagagcaaactcatcaaactccatgaagggatgtttttcctaatagaaatgaaatttctattactattactgctatttggttgctaaactaaacacaaacattttacttgccttttaatctagttgcttgtgattgtaaaataactatgaaagtggaggggagagaagctggtgtatgcatttgcctagcagttgattccaaccagtgcaagaagcaaccaggaaattaggccagtggaggagaggagttctggaagcccttcctcacatgctcatgcaagaataaaaatattcacgagcaaaattattatatcttatctattaccaaaaggtatttgatgtggcttagtggtaggtgcaggactgtatttgccagtattctagatttatatcaatattaaatgtattgaaactaagaatgtgttactttgaggagtagagtattgctgttcacattgactgtttggtctcaccatcggttacaacttacagggttggtttgtgtggactgcttctattgactgatgactgcatccctgcctggagaggtagtgggagtgcagtggtccagaggcctggtctggagtcatacctcctggactcttcctggctcttccactcccagccatgtgacgttgggcaagttttttagcctcctgagaaataggaataatagcaaaatttactcactggcttattgtgagaagtaattgagataataccaattaaagactttgaagagtgtcttacacatagaaagcactcagtgaaagttagctacttgtgtttatttacttgtatgcaggggtggaatcatatatttatctgtattgaatgtcatcctgttaggtttggtctctttgcaaactgttaggctctttttgtcactcagttctgcgtttaaattagtacccacctcagtcagtagtcatagtaacttggtaagtatcatagctccttagctgtattagtcagtagggctgccataacaaaataccacagactgggtgacttaaaggacatttattttttcatagttgtggaggttgagaagtccaagatcagggtgctggccagtgcagttcctattgaggagtctcttcctggtttgtagataactgccttcctgctgtgtcctcacatggcagagagagctctggtgtctcttcctcttgtaaaaacactagccctattggatgagaaccttacacgaaccctattggataaaagccttacactagccctgttggataagagccctacactagccctgttggataagagccctacactagccctgttggataagagccctacactaaccctgttggataagagccttacactagccctgttggataagagccctacactaaccctattggataagagccttacactagccctgttggataagagccctacactagccctgttggataagagccctacactagccctgttggataagagccctacactagccctgttggataagagccctacactagccctgttggataagagccctacactagccctgttggataagagccttacactagccctgttggaaaggagccttacactagccctgttggataagagctttacactagccctgttgggtaaaagccatactcttaggacttcatgtaacctttattatcttttcataggccctatcttcaagtacaggcacagtaggggttagggatttaatgtatgaatttggggggcagaggggacacaaacagtccatagcactaatatattactagaaaataaccttccagagtagagttgcacacccagttatggatccacctaaatggtcctcatactcagtccaggtctctccatcctgttcaccaagatgagtgagaccttttccagttctcttctgaagctcagctccagtatctgcatatttcccctatgtatcaatatgataatttgttaccaaaaaaaaaatctcaataattcactatgagttggtttttatgagcatatgctacagtctggtaatttttatttgatattttgggttctcagaaacagaatagttattagttagttcctagctgggaatcagaatcaatgataattaatgacacaataccttcagtgtttccaaatctaacaaactttgtcattaaattctcacattaagctaggtgtggtagctcacacctgtaatcccagcactttgggaggctgaggtgggaggattgcttgaggccaggagtttgatactagccctggcaacatagtgagaccttatctttacaaaaaaaaaatttaaaattagctgggtttgatggtgcctgcctgtaatcccagctatgcgggaaactgaggcaggatggtcactgtgccaccacaatccagcctgggtgaccagttgagatacatctcaaaaacctcatgatagctcatcaagataagcattatttttctttcaagtttacttatctgtcagagcagctctgcattttcttaacttgtctgtgtttggataaatgtttgaaattggatgaatatttttacgtgtcctttatgatttcttttttgagtcattggttatttaagaatatgttgacatttaacttccacatatttaagaatttcccaaattttcttcttttgttgttttttaacttaattccattgtagttagagaacatacttcgtgtgattttagtccttttaaatttattgaggctggccgggcgcagtggctcacacctgtaatcccagcactttgggaggccagaggggtgtggatcacttgaggtcaggagttcaagaccagcctggccaatatggtgaaaccccatctctactaaaaatacaaaaattagccgggtgtggtggctcacgcctgtagtcccagctactcgggaggctgaggcaggagaagctcttgaacccagaggcagaggttccaatgagctgagatcgcaccactgcactccagcctgggcgacagagtgagactccatctcaaaaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgtacatgtttataattgttgtattttcttgatggattgagccttttatcattataaaatatcactaattatctctaataatacttttttttataaagtctgtttcatctgatgttactgtaggcacaccagctctcttttgttactgtttatatggtgtggtttttttcattcttttaatttcaacttgtgttttgaatctaaagcatgtctcttgttgacaacatacagttagatccatttatgtttaattactaacaagataggatttatgtctggcgttttgttctttattgtctatacatcacatcttttgttcctgtatttcttcttttgtgttgagtaaatattttataatgtcccattttaatcccctttttttattatactatatcttttgagttattttcttaggttggttatctttaggattataattagcaccttaatttaaaacgacctactttgaattaataccaatttaattttaatagtacgcccaaaccttactccgatatagctgtttcctcttgcctccttgtgctgttagtgtcatatagaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacacgcctctttacgccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatctacctgttacctggaagcctgcacttcgagttcttagagtttgactcttctgcaacaatgtggatttgaattcctatgtagtatccttctgttttagcataaaggactccctttagtatttcttactgggcagatgtactaatgacagattttctcaattatacattgttattatttatgtaattttgtttttcaaagaagctgtgaggaaagaaggtgtatatacttatatcatttgttatattaaccctgttatttaccattttcagttctctttgttcctgtgggttcaagttaacatccagtgttactttcctactgtaatacagctttgctgtcacccgcttcctattacactgttactggtaaaccttacatttctgtatatgataggcccaacaatataattgcacattgagtatccctaatctgaaaatccaaagttcaaaatgttccagaagcccaaactttttgagcactgtcatgacactcaaaaagaattgctcactggagtattttggattttcagaatagggatgcataaattccaaaattaaaaaaaaaaaacctgaaatcccagacacttctggtctcaagcatttctgatgaagaatactcaacctgtacatagagtctcactctcttgcccaggctggagtgcagtggcaccatcacagctcactgcattctcaaactcctgggctcaagggatccttccgcctcagcctctcaagtgtctgggactacaagcccataccaccacgcttggctaattttttattactttttagagatggggtctcactgtgtgtcataaactcctgggctcaagcattcctttcaccttagcctcccagagtactgggattacaggtatgagcccagggggctcttttaggagctaccagacaggtcaaatagcagcagttccctgtggggtgtttgaggaactctaaattaattctgctttctccaatggctgctaggctaatggctttacaacggctgttgttatgagactgcttgtttttaaggttaatgcaaagctagggaaagggagatgggaataagacaagttaaagcagcacaaagttgttcttactgagatttagccatcttttcttgaatatacactcctcagattgttttaagagcttggttaccttccaaagttctgaaaaaattggttttgataatttttgccagtgttgttgttgcttctatggatgaatagatttttggagtccttatgctgccattttgaaagtacttctaccaggtgtaaatatttttaaagaatttgtcatgaccttctgtagaggatataatcttaatttgagttatgactctagattagaaccaaagcacacaccaagcaatcagtatttattgatgttctgagatcatcatcaaggaaagattgtcttattacacttgctttaatgcaatcactgatcccaatcgtgtgaacagatgaaaattcaattaaaaagtagttctgactctgcctagaactgtctcagaaggtgggaaaattgaatcaatacacagggcattattcataactcttctgcatagaactgattataatgggaattcacagaagggagagcatttatgttagaaaagtcagaggtagcttcataaagggaagtagaagttgaacccaatcttgaaggataaatggtggtgagtaaataagaggaagaccagtgtcggctggggcatgacattagcatcaaggaggaagacagcaccacagagacctgcccttttgctttagagagtttttgtttttttactgtggaataataatgaaaattaaaggtaaataagttgcagatagattctagaagtggcagctgattagtccaaagcccattaggcattcattaaatatttgtaaattaagagaaaaaagtaaatgctgtgttttggctacctttaaattattttgcagataggatttgaagttgacagattaatttctgctaaatcacagtttttggtgttgaatatgtgaaattttccaattttttaggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagagtaagtactggaagaccagaaacccttctgttaactagtgattgtaaatacagtaggtgatcactagagttcactgacaaaagcgactcttcagtagatttgtacttttaaatgttctattttaggagaaggagatagaaaaaaaagagagaaactgttatcttggatttccttaaaaattctaaacccaggttttggtctttttttgatctgagctaccacttcttttcttacatgattggacagttcagattacacataccccacagtgtggctgggggcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatggagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagtgtcatttatggcatgtatgtgttctaaaaaatgggttatctaggtattttttaaaagtttgaagctttaaaataaatagtaatcttttaatataatacagtaatcatcagtatttgcgaatttgcctactcattaaaatttatttgtaaccgccaaatcagttcctgaggtgctttctgagccattggcagacatgcccagggctgggagaaagctgggtctcctggcacacacacttccagctggagtctaagaaggcaacgctctgccttttttcccagttcaactataaaccagtgtacttcttgtggtctatttagtgccacagttttcacatttttgtgctttttgttgatgatttcactgttttgaaataatccccaagcttagtgaaatgctatctagtgttaattgtgatacacttttgtgttacagaggaaacacatgtattagagaagcttcattcaagcaggcatcagtatttatagtgctgctggccctgacttcaatattgatgaatcaacaatatgtatcaaataagacgtctttaaatagaaacacacataaaacaaggttacgcattgatcaattagagaaaatgtgaccagagaattgcaggaatctaactgtatttcccctggcagccgcggttcaatatttgctaactcagtgtacacagtgactttatagaacataaatactgtggttgggtgcggtggctcccgtctgtaatcccagcactttgggaggccgagatgggcatattgcttgaggccaggagtttgagaccagcatgtgcaacatggcgaaaccccatctctactaaaaatacagaaattagccagggatggtgttgtacacctgtaatcccagctgtgtcaggaggctgaggcacaagaatcacttaaacccgggaggcagaggctgcagtgagctgagatcgcaccactgcactccagcctaggtaacagagtgagactcttaaaaaaaaaaaaaaaaaaaaggaatataaatactgtatctcccaaaatcttgaaatcttgaactcttgatattaatgccgtaaaattaatcatttgtgacttaactttgaatttttataattatttccagcagtttaccccattgcattttagtactactagaaaggtaatcaaaaatttttttaaagtttatatttgctaatttcgaataatctgcaaccttttttcctttcattttagatggaaaacagccgaaaaatggtttcttgatgctttggaaaaaattaaagcaattgggaacgaggtattctttgtagtacctgtaaatatacacatatacacccctgagtgtttactgttaaatgaggaaaacaacacagaaatctcttgccttcgaagatagtaacctgatattttcataacaagcggctgttaatgtttgcattgtcagttaactgttttaccacatggtaagaaatgagttttttccctaagagggcaagtgttggcgtttgcttcttaaatgggctctagctttgaaacgtgagaggcatcagaatagattgggtgattatttgaagctaggaatagtcattgggtcacggaaacaattgggcactgtagcgtcagatgtaatattcctctagaacttcagagagcttctttgactgaagggtaaataaagtatagcagcaggtcccacttctgaaaggatagggatgggataggtattactgaaattcacaccttttgttgctgttactgcatactgagtgtgtatttgggcctttccattttaaaatatttgactgcttctgttgtatgaacgatcccgtgaattggtgcttatgagttaacctaacaattatcaaggatgtgtatatactgatattacttaaaagtagtaacagttttagataccataaacttgcatagtaagagatttgcatgatgctcttctgtttcattcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccccatagacacagctttgtttactttggtctctcatgtcatctgaacttataaacactatttctgtgtttgcacatgcgtgtatataaagcaggtgcctctgtcgcatagtcttgggtagttctggataatccaagtgttttgttaataggggattgccacttgccaccttgtcagttttctaagaagtgactgccttatgccccagacgggctcagcagcatcagcatcacctagaagcctgctagaagtgcagaatctcagaccaactgaatcaaaatctgcagttttagcgtgatgcccaggggattatcacgcacagaaaagttttgagaagcactttcctaaaccatacttaagttgagcctgtattctttgatgattaaggggcactaaatttagagtcttacagaaacttaatggttttaagtatgaaagcacaacactattgaaatgtcaaaatgctcattaaaaagttatacgaagagggggaaaatattgactttattagaaactgcagcaaatgtcaaagagaaacagtcatgcctaagagtcattaaatgatttgtttttcattcacatgggctgtgcctcctagaactggtctcaatagagttagagaatctgtggctcaggtctgttcattcatttagttgacatatatttaatgagtgtcagccatgccataggctctgagctaggccttgggatgcaaaggggaatgagtttactatttcctgacctcagatcaactggcgaatgtaagtacgtaaattgacagtgaaaatacggtgcaattgaggaactaaaggtgcccacagagaaaggcagttcacccagaaatgagccttttgcatacacctcagtcctgaaagtcatcagacatcagctaggcaaaaattagggcaagggtattccagtgtttgcaaaaattggagctaattcattatggcttggattttgagttcacagagaatgtcaaggagtgggtcaggagggttaagtgtggatcactaaaggcccagaatgaaagagtttgtgccttatcctgaggagaatgggaaaacaaaagggatttaagaaggaaacaacccggtcagacttttatgattggggcccagatttgactctgttaatgaggaaggtgaggactaaataggttggagttatgcctagcaattagaaggaaccagccctggtgtgcctcatggaagggtcagagggggtgggggtgccattcactgactggaggggcactcagaagcagtgaggtcaggggctgggatggccagggagagatgggtgtggtgtgtggtgcactaaacttaaagtgcttgtaacatttacaagcagaagtatttagcaggcagatggatagagaggtctggtgtttgagggaaagctctgagttgcagatactcatttgaactccagcagggataggctcttggataaacttgtcctaatgataacagagtcctcaggaagtctcctagtaggaaagaaagggagatagataaaacagcagttaccctggccttgtggtgtgctggcggcacacactgggagagagcccagcttgcaaggcgtgaaataattcagtgcaaacaaatcaggctgaacagtgacatatataactcgtgggcttgatgttgctatgttttaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttcatgagatcaaccagctttcttgtacttggctgctcagataaaatcagcatcaaatcagtttttattatttatctgtgttggtgtaattttattttagaaacacattgagaattttacttttttatatgaaaatttagtgttcaaaattaattcagaagaattaggacagtaggatataattaaaatcctatccatagtctgttttctgctagaggttttgtggtgtgataaacaggcgacagttgaaaaatgggttttttggttaaatatgtctgggcaattttaggttattcaagatttaacaagtatttctattgcaggatttctttgagtctttactatgtattacgaacttatagcattttccaaagtttaattgagcataaaacatttttttcacaaaagactttacaagtcaagtattccagagaactttaaggagcacttttctaagtaaatcttttggaccttaaagcgatactccttgactgcttttatctacccctgatatgggacactgactgtcacctaagagggtggtgtgtggtaagggcacagccaggaggcatggattaggttctggttgcagtgtcccactgaacatcaaaaggaatacagcagacatccctgcaggagtgcccttggccggcggagggagtgggcctggaagatgcatttagagggcatattgagatgcatgagagtaggtgtggagaacattcaccagtctagactgctgttctcattgagacagcgtttcttgggtgttgatatggatggttgctcatcttagacttaggaatttagtgcttttactgtagccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttccacacagtatgtcttttctttgtacctaattttaaatctggttaacattgaccacttccttttttgaaaatattttttctaggtaatattgacttactattttaatattctttaggcaaccttacgtgttattcttttctttgcagagaaaagcatgtgggtgttgtacagtattcatcaaattagaaacaaacatgaatcctgtccttagtgtttgcagtgaggtgcgcaggtgcccagtggcactcaccagtgatctgagtgctgagcacggggttatctgtccacagtagcccctttgggaactcgcagtctttctgttcatgactgtccccttagatcacattagtagatgaacaaaacagtctctgcagtcatcacaaggaaagaacctttcattaatccatgtaccatattccatcaaatttaagacaccatgagtaagcaggatgaccacaaagaaaaaagtgctgccaattaaactttaacataattttttcccggcacttaatttttttgtacttagagaaaatattcttgaacatatttaggcagatttgtattactctagtacatacatagaaatgtacatataagtgaaataaatggttacaatattcagcccagagggccagtatctgtgttttctcaaaatagtgccctggtgctagcacacacgcccagttcctgactctgggtttcctcccagccacagacacctgctttccaactctctctctctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccatatcacagtggtggctggtggatggcaataataggaaaccacaggtaaaagggaagcaatgtttgaatttgagaaaatgtgggtcttagaatcagtgaactaatggtatttggagaaagagataaaatatgagaaaatttatcaaagataaactcatgagcgcttcgtaactgattttcaagagttcattagagattttgaggttagatgaagtcatgaaggtaccatgatggtcaccagaacactgagtttgtcagaagtttggactaagcacattttctagtcctgtatgatcttttaaatatgtatatttgagtattgtataatttacctttcttctgagatctgattaatacagaaggctcagctgggcgcggtggctcacgcctgtaatcccagcacattgggaggccgaggtgggcagatcatgaggtcaagagatcgagaccatcctgaccaatatggtgaaaccccgtctctactaaaaatagaaaaattagctgggcatggtagcacatgcctgtagtcccagctactagccctgcgcccggtcccaggctgaggtaggagacttgcttgaacccgggaggcggaggttgcagtgagctgagatcgcgccactgcattccagcctggtgacagagcgagactctgtctcaaaaaaaaaggaaaaaaatacagaaggctcagaagaactctgtatggagatagaacttcttttttttcttttgagatagtattttgctttgtcgcctaggctagagtgcagtggtacgatctcggctcactgcaacctccacctcccagcagttttcctgcctcagcctccagagtatctaggattacaggcacctgctaccatgcctggctaatttttgtattttttattagagacggggtttcaccatgttttggtcaggctggtctcgaactcctgagcccaggtgatccacccgtctaggcctcccaaagtgctgggattacaggcatgagccactgcgcccagtcgagatagaactttttaaaaaatcttttttggggtagatttccagcataagaaaatagaatagtgtgatgaacctccatgacccataaccaacttcaacaatctttggttcatggccagtcatgtagctatgtctggccacttcccccaccctggatgccctggaatattttgaaatgaatcagtgtggtaagagaaggaaatatgttttcttttaataaccatgctgaatcttttatggcaggcccttggtcttaggcgagatgatacattttctgttacaatgcttggtcattgcatcgaaatgtacattggtgattctgaagcttatattggtaagataatcgttattcttattggtattgtactccattttttaggttgtcatatgtctctgtttatgtttctcatattctcgtctgaggttccaagttcatctttctaaccattcgtgctgcattaaaaacaagaaactccatttattttattagaacaatgctgtgggggagttagtgactcaccaagggtgcgttcagtttaaagctgaatacttgctaagtgcaaaataccactatagaatatgtgtaaagcactttgttatagaaggactcatctgtttctataatgggaaaagaaatcttagcaacatttttctgataaacaattgaagaggctctgtcattattttataatgcagggtataacaatataaatctttacatttcaatagaatgttgagatgccatacatttccataacagtgaataagtaatagtataagtttggatggaattgctgtacttgggcactcgtttagttataaacattatgtgataaggaggatgtggtgaggttattgagatctaggataggaaagttgcaagcttgctaactcccgttcctactaaagtaattttttttttttttgagatggagcttcgctcttgttgcccaggctggagtgcaatggcgcaacctctgcccaccgcaacccctgcctccctggttcaagctattctcctacctcagcctcctgagtagcttggattacaggcatgtgctaccacgcctagctaattatgtatttttagtagagactggtcttctccatgttcaggccagactggtcttgaactcctgacctcaggtgatctgcctgcctcggcctctcaaagtgctgggataacaggcatgagccactgcgcccagcccctactaaagtaatttctgatgtaatttcccccaaagtcaaaaagatcaggtaatgtgatacaaaacagagcagagccttagattttgagagggatctgtctgcttatgtgtcttggggttccctgaggaaaacagaggtttctcctaaaacggggtctgtggcaccctctggttttcccaaggagcccgaggctgtcagaaattaccttgggtcctctcatgtggacatccagagtggcgagaagacagactggggaactaatctagccaactgagaagaaaaacaaaaaatgagtaatacccattgtaaagttggataaactgaggcacatcacagtttaaaaatgcatgttcccataggctccacagctcactctcttaaccatcctgtaattgtgcctgctctatgcccagtcactgatgcacttgtgtggtagctcatggcacacctagcaaacagtttccctgcccccttagaacctgggtttcgtttcctgctctacggcagtataaacagtttttctctgcatgtgttgggttctaaccctatatatctcaaattttattaatattactgaatctttttttttttttgagacggagtctcgctctgtcgcccagggtggagtgcagtggcaggatctctgctcactgcaagctccccctcaccggggttcatgccattctcctgcctcagcctcctgagtagctgggactacaggcacccatcaccacgcccggctaatttttttgtatttttagtagtgatggggtttcacagtgttcgccaggatgatcttgatctcctgaccttgtgatccgccctcctcggcctcccaaagtgctgggattacaggcgtgagccaccatgtctggccaatattactgaatcttacagggggctgtgatgtctttaatccttagaaatattaatctatagacaaaggaatacatgaggttaaacagtattcacatttctatatgctttaaaacattcaggcaatgtattaagaaacacacctaagaaactgcagtgaatctactctggatgaaaatttagagaatatctcttcaaaagaagctatctaggccgggcgtggtggcccacgcctgtaatcccagcactttgggaggctaaggcaggcagatcacctgaggtcaggagttcaagaccaacctggtcaacatggtgaaaccctgcccctactaaaaaacaaaacaatacaaaaaaaaactggccaggcatagtggcagacgcctgtagtcccagctactcaggaggctgaggcaggagaatcacttgaacccgggaggcagaggttgcagtgagccaagattgtgccactgcactccagcctgggtgacagccaatctcaaaacaaaaaaaaaagtgctacgtattggtagttatgcatattcttacatatattaacagtattttacatgcttaaaaccttaaaaataattgaaaatgtcaaaattatatgccatatacatttctgtgggcttgaaaatgatacaatataggttgtttctttaaagcagtcactaaaatgtgtaaacttctagatagagtaatcactaaaaaggaaagttcataccaaaagtagtaatactaggaataaaagagggctcaacactgcctttgggagtcctcctcccatgaaacatggctggatttttctccttgtcctgtgtaacctcccttactttatcatagtttactgccttagttactctctcattcctccaaggagagcctcaagaaatttaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtcccgagttggaaaagggaaaggggggggagttcccctatgtagagcagagggatccccacatggagatagctccagctcatgcctgcaaatgaaggctctctagagagggaaaagggaaaaagaaatgaaaaataaatcccaaaatttgggcttacctcccgactggctcaccaaaatatgttactggtgtggaaggtcttcactacaagttgtccaggttcttggcatggtgaacaaagattgaacaaaacaaagcaatggaacatgaaagcataggtgtattgaagtgaaagtatactccacagagtgagaggggcttgagcaagcagctgatgagccccagttggggtttaagtacccttaggggtttcgtgttggttacaccctatgcaaatgaaggattggtctgtggcagatcagaggctgaagtgaagttacaccctatgcaaatgaagactgtgaccaatcagaggctgaagtgaaggctccctgtctttagaccgtattctgcctcagttaagaagcaaataaaggccctcagggaaatgaaattaaaaccataatgatggtggtgtgtgcctctagtgccagctactcagggggctgaggcaggaggattactggagcccaggagatcaaagctgcagcgatcacgccactgcactccagcctaagcagcagagtgaaaaccctgtctcaaaaaagtaataataataaataaaaccttagtgagaaaccagtacacacccaccagaatggctgaaagtacaggatgtggtgttggtgtgatgtggagcaacttgaactctcatagattcactgctggtgggttataaaagggtaaagcctctttggaaaactgcttaatatcacaataaagttaagcctattatatcagctctctattgctgcctaaccactccaaaacctcaaccaacaacgtgttatttttacaattctgtgggttgagtgacccatttgtgggtcttgtctaggtttactcatgcagctgtggtcagcagatacttgactgggtagatggtctaaaatggtaccattctccagtagggagctcagcttgggtgctgagtctctctctgtggggctttcatcttaggtttctttgtagcacgatgttcccagggttctaaaggacaagaaccacagttcaggacctcttgaaaattcagagttgcacaacatcacttccgtcacgttctgttccatcagtacaagtctcataagctcagagtcaatgtgggagggggctgtaccagggtgagggtgctgggaggtgtgattcattggggtgggtattagggtgatgattgaccatactgattttgtgatgtagcagttctactcccaggtatgagcccagtggaagcaagtgcttctgtccactaaaggtcacaaacaagagtattcatagctttattcattacagcacctaactggaaatgactcaaacgtccaccagtaggagagaggagaaataaattgtggtatgttcatacaatagaatactatattatttgaaagactactgaatcatttagaaacatgcatcagtttcacagatttttttattttttattattttttctgagatggagtttcactcagtcacccaggctggagtgcaggggcgccatctcggcttactgcaacctctgcctcctgggttcaagcaattctcctgcctcagcctcctgagtagctgggattacaggcgcatgccaccacacctagctaattttttgtatttttagtagagatggggtttcaccatgttggccaggctggtctcgaactcctgacctcgggtgatccgcccgcctcagtctccgaaagtgctgggattataggcgtgagccaccacgcccaacaaatttcacagatttttgacaaaaatgtgaatatgtactaattacttccatttataggaagattagtgtattagttcattctcgcattgctgtaaagaaatacctgagcctgggtaatttataagaaaagaaatgtaattggctcacagttctgcaggctatataggaagtatgatgctggcatctgcttggcttccggggaggcctcaggaaacttgaaatcatggcagaaggctaagtggggagccagcacttgacatatccggaacaggagggattgagaaagggaggaggtgctacatactttaaacaaccagaactcactatcacgagaacagcaccaagaggatggtactaaaccattcaggagaaaccacccccatgatccagtcacctcctaccaggccccacctccaacattgaggattacggttcaccctgagatttggtgggacacagatccaaaccatgtcaattagtaatgaacaaaactaattggtagcgatagaaaagtccaagaagtgcttatctcaggcttgggaaagctgacagtattgaccaggagtgggcacagggtcttaaggagctgcatgtgttctgtgccattctggcggtagtcatctgggatgcatgtacatagggttcattcagccatgtgcttaaggggattcacacttgactcttggttttagctcaattttaaaaaacaaatttaagctctggtttctgagagatgctaggttgaagcctcagctctgcccctcggcagccctgtggcaagaaaggcaagtctgagccttagtttcctcatttgttcaagggtgggaagttcataggaagctaaataaaggctagagagttgataatgagtcagagggatgtctccttgacctcgcagaagagatttacctttttttttttttttttttttttttgagacacagtctctctctgtcacccaggctggagtgcagtggtgcaatcctggctcactgcaagctctgcctcccaggttcacgccattctcctgcctcagcctcccaagtagctgggactacaggcgcccgccactatgcccggctaattttttgtatttttagtagagacggggtttcaccacattagccaggatggtctcgatctcctgacctcgtgatccacccgcctcggcctcccaaagtgctgggattacaggcgtgagccatcgcgcccggccaagatttaccattcatgtcatttttatttttagaaagtttgcatgtcattatctgccaaactacctatttctgaaagctattggtttgaactgtgtaaaactcattttgtttatgtcgaatgattgtacctaatacatctgttcagatctgttcaaatctatattacccttaaggttttaatatatgggaaatggattttatttcatcgtggcttttttatgcataagattggtgactatacccaatgggcacagcacagttctttttttttgagatggaatctcactctgttgcccaggctggagtgcagtggcactatctcggctcactgcaagctccatctcctgggttcatgccattctcctgcctcagcctcctgagtagctgggactacaggcacccgccaccatgcccggctaatttttttgtatttttttttttagtagagactgggtttcaccgtgttagccaggatggtctcgatctcctgaccttgtgatctgcccgcctcggcctcccaaagtgctgggattataggtgtgagccaccgcgcctggccacacagtgcagttcttacctgtaacagctgaggagaaagttgtccacaggcctcatacgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaatttttgatttacagaaaaatggcagagatagtacagagagcttatgtgtgcccctcacctagtttcccccattggtaacctcttctcttcccatggtacatttgtcatgactaagaaaccaacattgttagtgtccattcactaaaatccagccttgatttggatttcaccagtttttccgtaatgtctgctttctgtcccagagtcccatccaggcacatactgcatttagtcatcccatctcctttgcgttctcttgcctgtgacagtttctcagacttcccttgtttctcatgaccttgacagttttgaggagtactggccaggtagtctgtagaatgtccctcaattggagtttgatgtgtttctcaagcacctttctcatcacatcctactgggtggttgtaaccaccacacgacctatcccaggcagtgctgaccttggccacctggtcacagtggtgtctgccagatttctccactgtcaagttcctgtttttccctttccatactctgtgggttgaggaggtttcagctccaacccctggagagagcagtatctgtgcatgttattcttcttgaagatttgtttcttctctcctgtttattcgatcatttatcagtatggactcatgtttacctacaggcatgccttggggacactgcagttttggttccaaactggcaagataaagcaaatatcacaataaaactagtttcacaaattggtttcccagtacatataaaagttatgtttatactgtagtctattaagtatgtaatagcattatatccaaaaaaacagtgtatataccttaatttaaaaatactttcaggagttcgagaccagcctggccaacatggcaaaaccctgtttctattaaaaatacaaaaattagccgggcgtggtggtgggtgcctgtaatcccagctacttgggaggctgaggcaggagaatcgcttgaacccaggaggcagaggttgcggtgagctgagagcacacccactgctgcactccagcctgggcaacagagcgagcctccatctcaaaaaaaaaaaagagaacactttattgttaaaaaaaaaaatgcttatgatcctctaagcctttagcaagttgtaatctttttgctgatggagggtcttgcctccatggggatggctgatgatgatggtgctgaaggctggggtgaccggtaacttcttaaaataagagtgaagtttgctgcattgattgactctttcatgaaagatttctctgtagcatatgatgctgtttgacagcatattacagtagaatgtctttcaaaattggggttaatcctctcaaaccctgatgctgctttatcaagtaaatttatggaatcttctaaatcctttgttgtttcaacagtgttcagagtatcttcaccaggagtagattccattttaagaaactattttctgtgctcatccatagagagcaactcctcatctattaaagttttatcgtg[450 bp omitted]ggatgttgtg

SEQ ID NO: 14357 - DNA, 8116 bp, Human
aattggcaacctaggcctcgcagccgcctttttttagcctacatttcccaaaccagggaagaggcgggtgactaaaaatgcaaattgcagcgggggtgttagcaggcatgcccgtgggtgcggggcgtcgggcgaagggagaccccgcgaccttaggcgccctcgcggtgttcacggtaggcgcaaagcgcagcaagggacactccccaaagccgcaccccgccggacggctgcccccgcttccgcctctcaggcagcggtgggacaaagcgcggcctcttttccgccggggtttagggagggaaggccggattagggcccgcgccttccggctgcatccctctcgcgccgcgccggccgcacacaggtggttttccgctcaggaggggcaggcttcggcacttttatataacaatagagctctgcgcgccgggaacgcgcctccccgccgccgcggcccccacccggccacgcctccatccggcttccaatccgtccgccccgcggcgcctgggccgagtgctgctcgctggcctggcccgcacctccccaaagttacctgctggctttgcagcgcggtagagacgttcccctcgactccttgggagcgaggagccaggggggtcccggcaggcactcgtccttgctccccccaccctccccagatctctatggacccgggagtccctcgctgagccccgcacccgtccactgcgtcgcgcacagccccgtgcccaagcggggagacggggacggcggggcggtggcagggagcgcagcgcgcaggcgcggctggtgctccccggagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtacgcgcccagggaactccgcgcgcggggcagggctaggggcgcagggctgcgggcggggcgcgtggattgaaaatacctctgctccgctcagctggagcttcggagccgcgctgcccgcctagggaccggcagccggcgaggtaggggccgcgaaccgcgcgttccgcaccagagaaccgggccggctcagaatccactcgcttccggctgcgggtaccggcggtttctttctaacgggttctgcgccttcttagccagaacatcctccaccatcaccctgttttctatcgttcgattttgaattaagatttgcaggacgggagagattgttggggatgcaaattggcacatcttagctctcaaaatattccaaaaagttgccattttgtctatttccggattcaagcgaataagggttccctggcgaggcgggcccgttcgttccattcccgatggtgcacatttaaagtgtgtttctcttatagatggttctgtatgtagggggttcgtaggatgcttgtggtgtttcttgcgccgggctgcggttcttacaagctgtgaaaactactacggcttctcaggttagatgattgcttttctcgttctggcaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcataggtgagactaattaatagtcgtcgctctgacatttaaatgcaaaattcctagccattcatagagtttaagctgttaatcgttcttgctgcttgctaatttgtctgactgcaggtctctaatgttcctagagcgtccttaattctggtttatcttcttgctaaaggaagaaaacctgccttttgacatggctgcagatcacaggtgtatttgaaacgctgtttcttgaatctttgaattcagtcattgacagtcgttcataatcggacaacagatttttccccccagtctttggactcaggggaagggtcagatagaagtactcactatagacaggaattccagcattgctttataatttaaaaacatctaggagttattttaggacatcaagttagttgttggaaagcagtatgaatgctgaatgttatccagttgaatgatgcggtgatactggtaacagtgagacagtgggtaacctgagcccagcaggaagaactgtgggctggaagcctgggagaagtgaatctccaggcattgtaatgcatttcctattacaaaggaactcattttcaggccgtgtcgacatcctgttcctcctaatgggccgtcccctgtgacttccctctctcttttaaaatgcctgaatacctccattgttagctgcacaacatttggagcataatttaatagacccttgcagtctggttgtctgtgtaaaaggcattcacgaacatattgcagggtttctggtattcacatgccgaggcaaagaatgcacccattaaggagttttttgttggcagaaacttaatacaaaagctctcttttcagaaaatatctgaaatatgtaattgtgtccagtgtacatgtttcatttcagtgatacattttctgctgcttgtagggctcaactgccacacacaactattattattattatgttttcaagttcagtttttagactgatcattcacaaagggtggttttcagtctgctgagatcttgcttttctttttgtgttcacagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaatgtgtgtttttaaaaactcagttatacctatgtgtgaagtgacacattttagaactttttcattcagggattgattttgacttgtaggcatagtagggcaaggttcttttaagcttttcctagaacgtttttcagcagcagtttatgaaattcatcgtttgccacgaataaagatgacatcctagaatggaccgactgtaccgtgtatatgaacaatacctcttatgagtatagttccggcttaagattttaaagcccctgaagaaaaatgaacctatagagcatagcttgctgaggaatacaatttggatattaaccacagagaggtgtagcagaataccaagatgacagccacatgttaacctcctccctatccttcactgtcaggatcttctgctttataatgctgagataatgccaaagaggaagtagggataattctttttccagtctgttgtcatgggcaattctacctgcagatatcctagtgtgagaatgctgaatccagaatgatgtctccactttttcccctagcatgcgcatggcaaggcatatctaagcttcctcaccgtgtcaggatatggctttagaattttacattggcacttaggaggcaactttgtcatccctgttgtaatgtgcttttttgtttaactggcttgggatgtgggtcagaaacccttattgaaacttgtggggattattttagtttcttttcaagctaaagactttatatcttgccatttttcttgggacctaccctctccttacctcaaatgtaaaaatacacaaaccaaaataaaaggcaggtgtatggaatcaaaagaactagaacgtacttatatttggggctctttttgcatgagctcagtcccttcatgtgaagtggggagaagaatgagcttttcacctacatggcacatgagttgactgcttggtcgtctacactaacttaggaggcaagtggccttcattcgatggcaatcatataaaactgtccatggtgatttttaagcaactaagtataaaaagcaaacagaaatagtgcaaatatatatatataccaagtcagtctgtcctatttgggtgtcccaagtcagcaagagcacagaaaggagaagtggattgcagttcaacttggctcgtgttaatccagttctgaacggtttccgctcctggcattccctaaactgcctgttcaaagtaaggatttgcaagcagcgttagcaatttcctgtccagctgcagctcaagtagctgggtgcttttcccccctttcttttctctgatttcttttctctttctttttctttctttcgttttttaaaaaaatatgggctgtggataattttagtgcatttcctctttgtggattattatctctttcctcctagaacctgcatacattgagttcctactgcttggctcaagccgacagctggcctccccagcacttcctctcgttttactgtgggtttgttgtttgtcagtccacttctgaaattaataatgttttctggctaagtgccacaagccattaccacaaaggggaagtaacacatatgaatagcaggaagccatgcagggtcacagtgtgagctgaacctgtggagggagcataattgagcctggcccattcagcaagtgtctgactgcaatttggggagagggagctcgctgcatctaagcagctcaa

SEQ ID NO: 14358 - DNA, 11261 bp, Human
agttatccctttaaggtgcgcctgagacaaatgcatatctaattgcttcccctcccctattgtttacctaaaaatgataattcactgagccagactaaattgtgtattcagtggaaggctgatcaaggactcaaaaaaatgcgatcttttgcctcttatctactcatgacctggaagccctcacctcaagtcccgctttacctgactaaagtacatcttacacatactgattgatgtctcatgtctccctaacatgtataaaagcaagctgtaccctgaccaccaagggcacatggtcatcagggccttctgaggctgtgtcacgggtgcaaccttaatcttggtgaaataaactttctaaattgatggatgccggatgtggtggctcatgcctgtaatcccagcactttgggaagctgagacggacagatcaactgaggtcaggaattcgagacaagcctggccaacatggtgaaactctgtctctaccaaagatacgaaaattagctggttgtattggcacacacctataattccagctgctcaggaggctgaggcaagaggatcgcttgcctgggaggcgaaggttgcagtgagccgagatcatgccactgcactcctccagcctgggtgacagagcaagatgccatctcaaaaaagaaaaaaaaaaattgatggagagttaacttttggtttacaatgtaaatgtttatttaaaaacagacattattttatgtaccattacaaatatactgctacccagctgctcgggaggctgaggcaggagaatgcttgaactcgggaggcggaggttgcagtgagccgagatcgcaccattgctctccagcctgggcgacagagcgagactccatctcaaataaaacaaaaacaaacaaatatactgccaactaaactgtgattttgtcaaaaataaatgttgttgatgactttacttccattaaagccactgtagtagccaagggaaagcttcctttttgtcctctgaaggttcactgaaaagtcaactgacaaaaggcacattaattggagaaagggcatacaaatttattaacatgcacatgggggagaaccagagtgattttgctgaagccccaaatggggttcagaaacttatataccatcttgaggttacagaatgggggtttggattgtggcataacaggttatgcgggtggagacctggctgacaaccacggtcttgttatgtaaatgaaacctcctaagtagaactccttaaagagaacaggtggtacatgtttctttcagacctttgcaaaccaacagtaaaattctaaaccctccaaccgactgatggaccctctgcttgcccaagggcattctgaagttaacctgaaaaactagttcaggcaatgatgggaagtgggggttggccatgcctcattatacactcctcccttggaattcaggtacagcaagccagcactaacattaaaacagagaccttaagactgacagaaaagactcttctgcagaggcttcttcattactctcaggcacacaggattcttggtttccgctgtagggtcctcactttacctgttcaaccttcatttgtctttcactgcctactcttggttagcactcggccagcgcacaggtttcccacaccctgaggtggacaccagcagggaaggtttgagggagggctctgcctccctggcggccacccgcaggcccacagcaagacatgtgcagaggtgagcggagcgccgtcaccagctgccactctcccaaagaccagaaccatcccagagcacccggaggcaccaggaaagcggctcggaggcagaggcgccaggggcggggctgatgccgagaggtttcctctgccccgttccctcgcattggtcctgcaaccgctcccgtcagacgcgtttccgcctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcggaacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgttgttgttgagtattttcagttttacgtgcagaggataaaatatgtgaattgctgttttgtttgaagataaaacttttctctgcattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaaatttttcatgcctggaacacctttgtaaaaaaaaaaaaaaggctgtgaagtctgaatcactgaataatgtcaccatataggcatttaatttatgaccctttatctaaaatgccagaactatagggaatatagtactttagagacagcaaattattagactgtcttcaaaactaaatgattactaatagtgctgtcctttttgtttcagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatctgtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttagcttctctgacccaaggtatatcagttctattttaacgtacattacaaagactaatggttatacttagagacacgggtctgttggggacagcagtggcttagggtggctgtaatcccaggaaggaatgtggagaaggaaatgaacatttttttttttgagacggagtctcactctgtcgcccaggctggagtgcaatgtcaccatctcggttcactgcagcctctgcctcccaggttcaagtgactctcctgcctcagcctcccgagtagctgggattacaggcacctaccaccacgtctggctaatttttatatttttagtagatacgggatttcaccatgttggccaggctggtcttgaactcctgacctcaggtgatctgcccgcctcggcctcccaaagtactgggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggccattcttagtcccttcacaatatattcataggattaagttgccaacattaggtagtaaaagcatcatctgggagatatattttgatgccctctgagtcagataaactgaaataatcactttgaggtgattgagaaggcattagtggcacactggcacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacagtgctctccacctccagtgtggttatgtcattattattagtgcctctgttaacttttgttattttaaataatgtataccttcctttcttgttctagtaattaaagtctttgactatatactttatgagaggagtctttactgtttaatcttggtttgtggatttgttagaaaaaatggatataagcattaaagataaatgtccttccctgcccaaaaggatttgttagcatcaaaatccatttgggtagggtggaaatgctcttgagctatggattcactaaccttaccaaagtcatagctaatattggtttgtttctttgggtaaaaaaggaattatgaggaccatacacaaaactctgcttggttcttagtgccaaagctctcaatgtccaaattgaggtgacaggatttgtataaagtgattccatatcagggtggctattctgcctattcactctttgagtcagactacttctaagattcctctctggtctctataactacattgatagatgtcctttctgtattcattactagtaattagtgtttcttgagtcaagagtaacaacatctgcaatgatacaaagtaaaagttgcccaaatagaagcctcagcccttttgagtggcatattagtaatgaaaataattcattaacagccacttgtgaacttctttctcaaatggaaaagaccaaacagaaggtgagaggggctttgaagtcataaggaagttttagattgttaaacatgttaattgtataatgtctataatcctgctttgtagtatgaggattgaaagaccaagatccctataatcatcctggctgagaaggtctcgtgctccctgctgtgaagcagctttctaactgtgtgtcaccctcttctcaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccggcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaata

SEQ ID NO: 14359 - DNA, 22121 bp, Human
taaagccattataagtatgattagagatttatccaggaccttcggtggcttcaggccactttttgcaagtaagtctacagaagaaaccgcacagtgattactgcactaatttatcctcagaaaagagttgtttgctgggtatcttcatctcctggaaattgaaacatcaaatccgatattttttggaggcaatcaaattaattctgcatagccttctagtgtctgtataactaaatgaagcacagtcttttcacagaaaagtctacctagagatttggaaaaccatgatggcctgaaccgagagacgggagaccctgcaaataaagtggtgtgtattatatcttaagcgctaccgtgcccgctgtctcaggcttctgacaaaatatttaagtctcaatgttggcagcaaaacaggcgggcacagatctgggtgaatctgcttctaacatggagaagaagcggatggcaggacagggcagggtaaacttagggtcttcgatgcaagggactgtcctgtcccgcctgccgccgcccagccagccagtagtaccctgagccccacaatcgtacgatgggaagctgcctgcgaaacacagcagagtagggcaccaggcgggagtggcggccgagtggccgttacaggccggaacggcggcagcacgaaagggaggaacgtcccccgaggggcctgcacgcgcgccaattcctagtctcttccccaccattgcccccaggcctcagtgcagtggtggccttcgcccgaaccgtcagaaaagagtacaatctgttacctgggtcactgcaaagatcactatgggccagcggaagcgaagttaaacagccggcggcccaggcgcccgccacagcgaacctgcccgacctcactgaacccctggcgcgcgttgataatgtcacttccgccagttctgccctcggcttcagcgagttgctcccactagggccgaggccatgagaagtgtgagcataggtcacttcctgtgtttccataggtaaggaggggcgaagctcttgaggagttccggggcggggccgccgtgccacagccatctctaattggcccttgctggacgtaggaaagatcgatttttaaatggcgtgtgtgtgtatatgtgtgagtgtgttttgttgttgttgttgttgttgtttaaagcaactagcggcgttaccttcgacaagttacctgacctctcccccgcattttttttctgtaaaattgaataatgataacagtgcttacccttgggctgtcgggagattgacagagattgacagaatcagtgcctgagcagtgcttggcactcagtaagcgcgtcctccttacctgtcagcaagaacgctagctgatcttcaagcgtgtagaatgacaaggaacactaagcaaaacaaacagcttgtgtttacacatgcatttatattcagttctgccactcccagttcatgcactgttgtcacatggctctttccgcagttgtttcttagtgggacttcagcacgccttgattttcccttctgtagttcattgtggcgtaatcatatgttatactgcttgttttctttgtactttttattatcagtgaggttgtgagctctttaaggataggaaatgttatatacattttttattagccaggacaattaacgttcccaccgttattcgagttgccgttgcgccatagttctgacaatttttttgtatggtcagacttaaatttttgtccattggggtgaattccaatgttttcttcgagggggaaaaaaacaaaaaacaaacaaaaaaaaccctttacatccctgtcagcgctttttggaatgggcgggattcaactaccaaagggacaagccgccgtgcagccctccaggagcaacgactagcgtgagatagagaggccgggagcgaacttcaggagaagccggaagtggcgtaacgtccggtcaaggcagccatctcgccgtgagacagcaagtgtcggatccgcaggcgcagccgtgcgatgttgtcctctacagccatgtattcggctgctggcagagacttggggatggaaccgcacagagccgcgggccctttgcagctgcgattttcgccctacgttttcaacggagggtaaaaaccccagagagctgcggctttcactttcgcccttcccccatctgctgaagcctatttaggagtcaccgccgtgatggcgctgccccgggctcctgcaggcctcagaaccctgagctgagggggtccgcacaaggccggtctccctgccgtcctctcatgcgctgtgtttccctcttcaggctcgctttgctcaagtttacttggtgattgcgatacagccttggtttttagggtttcccattacagtcatgtcatttgagtttttatgtggaccgccactccgtgctccttgctgctgtaagacagtaaagtagaaattgaaacatagcctctgctctgtggaagaccattaaaactggacctcatgtacacgtttcttatgccagccggcgagggtagagggttagcgtctgaaacttaaaagttagggttgtttggtctgtgttgttagatgcatagctgggttggtagccgagatgtctaattgtagccgcctgatttctgttatttctaattgtagcagtttaatcattttgttttatttcaaatagaaggtgggattggctgagcaaacttagtttcatagataagtgcttttttttttaacgtttagcttaagttcaggaaaacaaaatactcagaagatggaccttttagtatgtgtgttcttgtatgttatgttcaagttttggtttttattttaattaccagctttatcttgagtagtataattttccgtggtggcacgccagagatttagggttatagaaagatgctctgtttaagactcttgacagggaagagctgtaaattgaaacagtggttatagttaccaatcaagccttgtacattaaaatatacacacgcaatttgaacgaaccgatggttcttaaaacagaaaatattggctgggcagtgtggctcgcacctgtaatcccaggactttgggaagccaaggcaggaggatcatcgcttgaggccaggagttgaagaccagcctgcgcagcatagcaagaccccatctctacaaaaataaattttaaaaacaaagcaaaaatgttaattggttcctcataaatttgaaatataaatgcacattttgggagtgtgttagaaagataacgaaagtctgattttagccttggttctgccactaaaggacactttgggtacttctgaacttcttgaacctaaatttccttatcttccttagtagcttcatagtttttggtgagaatcaagagagatgcattttgtaaattgcaagctgtcatcttatttaatcctcatgaaaagtgaatgttagatgatattagcatcctagggttatattagacgttaaactgtcagggtcagagagctggtgtgaagttgagccaggacttaattcatagctatttcaccactgagtttatggatgcttttccattatacaccttaacacttcctgtgatgactaattaagttgtatattgtagggagggttattggacccgtttcgtaaggctattctctataaataagaattttcagtgttcagtatgccctactcgttactcactttttaatcccttgtaatccagtttaagccattactgccctaaaaattacttagatctttctgattactttttctcagtcattgttctttttctttagtgattactgcagctggctctcaggcagccttcgcttccgcaaaatgaggcctcattctcttttcctactctgtctttaaatgtagttaagtcattagccgccttgtttatcgctcagcactctttcatgtctcattgctgggaggattactcccaaatctggttttccagttctgcctctcatgagtccctcgattcggcttcttcagtaaaacatttttaactggtttttctgctctcagggcaactcaagacagctagcaaaacaaaaagcaagctaattattccccttcatctcctcttctcctttcttcttattttttgagacagagtctcactctgtcacccaggccggagtgcagcggtgcgatctcagctcactgcaacctccaactcctgggttcacgcatttctgcctcagcctcccgagtagctgggattacaggtgcctgccaccacgcctggctaatttttgtatttttagtagagatgggtttcaccatgttggccaggctggtctcgaactcctgatctcaggcaattgaccccccccccccctcagcctcccaaagtgttgggattacaggtgtgagccaccgtgcccggcctcctctcctttaaaatacttataattatgccatcattctgctcatctaagttctaaatcttggatgtcataattggttttcccagttcctaaaacatttgcgtagatataaaaatttgtctattttgtgtgtttgtgatgattttggatttactgttcaccctgctaccttactattgcattagtagtattagaacagtgtttctgtcccatttcacatactatgttgttgtcagagcagtcttcctaaaaccccactttgtaaatggaacttttctctctcttgcattccttttttaaagaccaggtctcactctaatgcccaggcacgatcatagctcactgcagccttgaacacctgggctcaagcagtcctcccacctcagcctcttgagtagttacaactacagatcattcttgctcagaataccttcatgatttcttgctaaaattccaaaatctttagcttggcatttgggattttctacagtaggaaccctgtccatcacataaaccttaacgtcactacatgtgcttatgcaaaaagggctgcctgaatgagttgcttgaatgtatgtactatttgaataattacctgtttgccattgcttgctgtttatattacctggaatgccatccttttcttcttgagagctttagcacaaatccctcctcagtaaaaatagtggcttaagtttcctgagtgcttacgtctgtgaggcaccatgcctttaatttccactattgcattgaagcagtggttatagttatcagtcaagccttgtacattaaaatatacacacccaaatatatatacacaccttgtgacacaggtactgttatcatcaacttgcatttggaggatttgtccaagatcacatacctagtaagtagcaagagtgggtctctgtctcatgtaattccagagcccaggtgcttagtcatactccagtgccatagcacttatagctaacacttactagaggaccagttacatgtcagggactgctataagggcttacatatttgatcctttgaacaccctaatgaggtagcaactgcagtgatctctgttgtatatatgatgaaattgacgctttgagaagtaacttacccacagtctcatatctgcgaaacgggaaagccagaattagaacccaggcggtctgcttttggaattctactgtaagtctctttgataagctgtcaaattgtacagccacagagggaaaaatttactgtttgtccatctatttgtcattatataagggattgggtataaagaaataagcattatataggcgttatataaggacttggatataaagaaatgaagcaagaaaaaaaaatctcatcttctctaaactcatagagcttgcgttgtagtaccactgtctatacctgatcctcaagggcacagatggggtatttagttgttctgtattagtagtaccttgcgcgagtaagtatttaatgtgttggtgatgataattcattggcttttctgttaactcctgccaaggagactttgccctgatttaggcttattaataatttttttttcccagacaactcgtagccaggcgttcattctcttcccgctcatctttcctcttcccatttgaatcatgtttttgttgacatctagagtattttatcccattatgtactatggagcattcttctatttgtagggataggattaccaccctggagaattaatttttttcttttttcctcagtactatactggcaattgctggagaagattttgcaattgttgcttctgatactcgattgagtgaagggttttcaattcatacgcgggatagccccaaatgttacaaattgtaagtaaatatttctaaagacatttcacaatgcctttgtaatgatttaatgttgtgagagtttctacttctaaatgatttgtttcatgagtttttaagttgctgttgggagcatttttattagaaaaccattttctaagttaatgtttcctaataatttaatgtgcagtcttaataatatttgctgtattcagggtaccaaaagtgctttcggtaacctaaatgtgttcaccccagcattttaccatgaaaaatttcctgctgtgtcttaacatggtggaaggccagagaaagaaagaagagcaagcgaacccactgctgtgataatgtccattcatgaaagctgagccctaggacctaaacacctggtcccaactcccagtaccatcacaatggcaattaaatttcaacatgagttttgaagggaatattcaaaccacagcaccattaatccattaaatgatattttttttaaatctgcctccccacactttttttttttacctgaaacattcgttttagaaatatcctaagcaattatgtccacagctcagttttaataggctagctatgtttttcctaaaacatgaaaataaagccaaaacttaaaaaaacaaaaagcctgcataaatactgaatacatactgcagattggcagtggtctgtatttaccagttttggaaatgcttataaatggtcatgaattcctgggttaattaaacttgaattgtaataggaatgggacttacgaggtttaggtcctttggatggaccctccttgtattgtaggaagtaggtacagaagaaaagatacgttgtctttcctgctcctagggatggcccacatcttaaaaagcaatgaagtttgttttcgtcttcccagttctgtttctctccacttgcatcttttgataccccctttctgctttctgtttatggtgctcttgtgttacctttttttctcctcaaggacgacacttgtacaacttgaaagtagtaaatattagaaataagattttaaaacaactttatggataccatccttgtactagcttttactcatcttttaaatattgctttagttacgtttgctggtgaagtgagcactttttttttttttttttttttgtgaaacacgtcagatatagagatagagaataagaacaatgcagcattaacgaatgcctgtatatatccctcatcccacgtcctgtggggctgacctagaactaagcttgcctcttccaaacctgtttcagactgtattctttgcatgaaaactcccattcctttgatgcacctggatatttgggaaaagcatcttgaagttctaagatttctgtctttccctgttggtattgtcaaccaatcttgtcagtaaaggcagtaaagccttataggggattggacgtcttcaccttagtgcagtgaggttgatggtaggcatagatcaggtgatgttagtgatgaccctagaggtgtcagctgctctcctagtaggacaggtatggtttgtgcgagtcattcgtaagtttccaagaggaattgtgtggcctctgcaaaatattgtttaggtttctttatagattcatatcaagatctaggaattaatttttgaaatacacggttgaatttgtatgtctataccaaattttaatcctctccatacagatggacatttaggttttgttttgttttggggtgctatttaaatgagtactcactggtgagtctagagcatccctttgcatacttggataagtatattaacaagatggatttctagcaatagaattggtgagagtggtgtgtatttaaatttttaataaataccaccaaattgcccatctaacaggttaatcagtttatactgtttccacaacctcaccagcatttagttagttaggcatttttagccagtataattggttgaaatagtctctttttgagatttggatttctgagtaacatagaggctcttatgtttatggtgacttaatgtctcttttttctgtgacttgtctgttcatagaagttacccatctttcctttatgttattgctttccttatttgtaagaatttttatagaattaaaattagactttggggttagatgctactaatatattttcttagggttttaaaaagctattcttaaatttccctgtagaattttatgtagtcaaatttatgaaatttttctgtgtggcccttggattgtgttgtttaaatctaccttcacgaggctgggtgcagtggttcacacctgtaatcccagcactttggaggccaaggcaggtggattacctgaggtcaggagtttgagaccagcctggccaacatggtgaaaccccatctctactaaaaatacaaaaatcagctgggtgtggtggcgggtgcctgtaatcccagatacttgggaggctgaggcaggggaattgcttgaacccaggaggcggaagttgcagtgagccaagattgcgccactgcattccagcctgggtgacaagagcgaaactccgtctcaaaaatcagtcaattaacctacctacgtatcttcctcagcccaagatagtaaaaaaaattcacccatgatttatttagtccattcatagtcgcatttttaaagtctttgatccacctgtaattcatctggaataaggggtaagatggaatacagacccctcctccccagaagggtgactgtttgtcccattaccatttagggaatagtgggaatcagaattttaaatttaaaattgccgaagatatgttttgctctactatctaaccagctcagttttctgaaatgtgctttttacagaacagacaaaacagtcattggatgcagcggttttcatggagactgtcttacgctgacaaagattattgaagcaagactaaaggtagatgcttttgtacatttctacactattttaaattaatagtaattcattaaattcttttaagcctacagcatgactgttggtcagatagctagagagtcactaggttagtagatgaattacaaatgtatgctagaaatgaaatgatatcattaatgcagggtcattaaagtagcataatgtgaaacagcagcacattccatttgttaaagtcttgtatcatatgaagggttctctacccttttagaaggagcctgggaggagttcttcttctgaagatactcttccctcaaaaacaaagcaaatcaatttctgtggcaggagagagcccaggaaagatttgacacaggagcttggtttgcatcaccatcagttgacaagcttttcctctttacagtgctgtgctcttagttggcaggatgcatgagtagaaatatgaaagaatgaataagctgggagcttggatgggaggcacaacatgcaccattaacgtctgtcacctgaccagcttcagttgatagccagctgccagaagtcaggggtgatcacattctgttttgcctattcatgaataacacttgagattatttacacttatgagtggttactggagtatatagtatatttatttaactgacacatgctttttgaatgtgtagaaaggatttcactcagtatttatcaattgttaatgcttttttagaaacttacattgaaagccatagtgacttacatttattggcatatttatatgataattcctaatgcttattttataaatgggagttagaagacaaaagtaaacatgatattgttaataaaacaaggaatggtgaattctacataatacacaccccttcctgaagtttttctctcatactttattaggtggtgaagtaaataaatgttggtgcttggtttcgaaatgaaatggaatgaaatttttttttttttttttgagacagagtttcactcttgttgcccagggtggagtgcaatggcatgatcttggctcactgcaacctctgcctcctgggttcaagtgattatcctgccacagcctcccgagtagctgagattacaggcacctgtcaccacccctgtctaatttttgtattttagtagagacggggtttcaccatgttggccaggctggtctcgaacccctgacttcaggtgatccacccatctcggcctcccaaagtgctgggattacaggccagcagtgagccactgtgcccggcctatgaataattttttatagtttttatcttggaaaggcattcctctataaaaaacttacctgttacttgtagttcatttctaatcatttttcagtgttttgactgtcattatttaattttacggtgctagttagatatctatctgtctatttatttagagacagcgtctcactttgttgcacaggctggagtacagtggcgccattgtagctcactgtagccttcatctcctgggctcaaacattctcccgcctcagttgagattacaggtgtgagccactatgcctggccattaagtttctcattagagatgtttgctatgtggttaacaaaaattggtgatcttgaattcattttatgtttataatttttgtgaagtttctctaccagtgggtagtgtagggctcgcaaaggtatagtaaagctaggatttgcagtcactgtattgtcatgctaagaccctgttttggatgcttgtgttctctactgtagatgttttaaggatcacgaccactgctgtgtattaaaatcatgcagagtaagggtgctgccctgtgtcttctgttctcacagagatctgctccacaaagagagggacttacatctaggtttgatcagggattgccgtaattttttctgtaaaggaccagatagtaaatatttacagctttatgggcctcatttgatctgcttctgtagtgaaaaagcagccacggacaatattcatagcaatagggagtaggctggatttggcccctgagccaaactacaggggtagtttgttgacccctggtctatatgcagagtgagggagagagatggatttaaacccatcttccttaggccacttcatgtgccctttcatacacattagctcttggattagcagtacctgagataagggtggtatggaaaatagagtctaaaccagagagctgagggcaaacttggcattccttcccttaaaattttatgttagtaatactgtgttggttgatcatgaaggaaataggcatgctttccccttccactgtggtatgcatttatttattcactttatactgttgattgttctagtctataatggcctctgcctctacatgcctgtgacttttatcaataattgcagatgtataagcattccaataataaggccatgactacgggggcaattgctgcaatgctgtctacaatcctgtattcaaggcgcttctttccatactatgtttacaacatcatcggtggacttgatgaagaaggtagaattccttctttctggaaaatggtgggggggaggagttattattccctagatgtgtgtatccatctagagttgaaaagaaccataaataccatctgacacaattctcatttcatttctgataatgaaagtgatgaagaaactgaagctaatgtatgacctccaaaggcacattgaagctctaatagtgaatgttgagcagccagttattttgctattttctcaggaacttgcatgagttagtagtaaataattaggcatttttatcttatagaaagaaatcggacctagaaagcttgacctaaatgtgattctgagtattgaaaatttttttattaacaaatacacttcaaaaaagttctttaacggttctagaagtcatttggggtaattaataataagcatctactccagtgttttcagaactttttgaaacacctctctgattttgtcagagtcagaccaggattccctgagaatattaagtcttgttacttaatattccatcccatttttgttccagagctgcattacgccacatgggcaccaatgttttccatccaaatgttccaatccatttgttctcatttgcaatccaaatgttctcatttggattggcttttggttgcatctaaaaatcaaatacaagtacagtgtcccaggacagatctttgtcacttagagtagtccattgacacagatggataagtagtccatctgtgtcatttagagtagtccattgagataagaagttacagaagtgtctagatgaggatatcattggagtaagcccatcttctgtgttccttctggctgaacctgtggctgaagttgccctaaaagtaggggcagaggaattcctgtaagggactgccccgaacctagttggggttccagaacactaaatctcagggtaatcagtcaaaagcatttagtgctgcagcagtcctctcagcagacagcaggaaaagatgtgtccaaggtgagggagttgatttgagtgttgaaggaatttggttcagggccagggatagtttctgtgtgtttagcaacaggggtaatttctcagtgtttcaagcaatagcctaaacaacattgtcagcgcctgggaatgttcaaggcaggccttggcttgggtcagagcctccaggggaatacatgcggctggccacatcacagaacatctcagttggacacagaaagaaagcaaggggactggggaccctaaatcctgtgagggaaaattctaagaggaaagggtcaagcttcatttcagcgccctgcctctcggttgttgactcctatcgctttctgttccatgagcgttttctttgcgtgcgctatctctgactcttaacatccgcccccatacacagccttggggaacattctgatcattttacctgccatggtttaggcgtagacaaattaggttgacacaatttctttttaaggctttcaaccttacttgaaaaccaagagaaaaagtaaagtgtagaaatagtaaaaatagaaatgaattacctttaacatgggtaattagagtctagctacaaattaatttgcctaacttagcaagctggatgcttctggtgtcttttttgacttacattatgcctggctttaatgtcagattaatagattcagattttagcaacattaaaaatagctgagctgccattgaatttcagcgggccagacagcatcctttgagtttttccgagagttagagagtctaatctgggaaagctgatacctactaagcagcagacctaagattcaggtttggcttttgtttcacttcagagccctgttctttgatttccatgtaacagtgttgctagttttggtgacaacctcaggtgtctctagaactgtctttctaagcttgtctgtctggttggcttttaagtgttctttaaactaatttttattttatagaggaatttgtgtgaataataaagcagtcctctatcttttttttccattgccctaagacagttttcagctcttttacctgtatttcctggtacttacctccattttccaaaactctgtatttgtactgcactcttttgagatatcttttggtgttttgttctggtagatgatggttcttagctcttttgtgtcctcttcctcattagcatcctcctttaacacattacacttttggtaacatagacctttaatgtttttattatgaccagatagatattgatctttgttgcgccaagtagcatgcattaatattttctttcttgtgtaactcgtttttatttttttcttaagttaactatctctaattggctcagatttctttaaactttttgtcagttccttgtacattctctgagtacaattcatctggttgtcagacctcacatactaggtggatcccttttccctttgctccaggatggaccactgccatcctgagattcccccacatcctgtgttctcctctttcttgatttatttccttattttagaggcttacctcctaaaagatttctgaaaaaaacaaaatgggacctttttgagactttgcttttaggatcttttctttaccctggtgttctgaaattgtatagtgatgttccttgcctagagtttcttatttgttttatcctctttctccaccttctttcctctcctcctcccctacccctctgcaccttctccacaaccacctggattatgacccggtactttatttttgactccccatgttatccatgtctgtcttttttgttctactttatgaagatttccttaattttagcttttcatcctttactgattgcttttatttctggtgtcattaatttccaagagcttgtacttattttttgtctttttaaaaaaaatcctgtttactttctttgcagttttctgtatttcatcagaatgctttttttttcatgttgtgtgttcatttttggcctctgtcttctatgttagaggcttccttcaaatctctgatttttttttttttttttttttttgctgtccattcacattgaagagtcttgtaccaaaatttgattatgaaagtccttgttgacatggcttgtcaactgacagccgttaactgggtgcttaagtaagcagcattttcttcagatgaagaatttctttaatcttttttcctgaggtgaggtgggactacaggaagagaagcccggttggcagctttttaggcctcggaggaggaagggggctgaaggtctgtgttttgtttacatcaactttccatttcatgtgttttgctcctaccctttgccactctagagcctggtcccctaagtccagagcctctgctaatgtctcaggagacttcctttactgtcttctgtgttggtggatgcagggacctggagagcagtgctccatattgaaaccttcaggacagcaaggtccacagctctttcccttggtgtcaaccgctgtctgcactaacctctctgtctttaatctcttagctgctctcatgccttttaaaaatttttctcccaaattaaaagtggctttagtttttctgtagtgaaaacaatcagtacatgtttatacatacactcatgtagttttatgtaagtaggactttggtatctgtttttctgtaactatacattatgtattatcaaggagatctaagctatatgcataatgatttttgtatttaattaacaaaaaatttttttgtcttctgtttttgctgctgtaatacatagcatcatttacctaaccagtcctctaaagggcattttggcttcctgttttcttaatgtaaacactatgatgaacatccttgtacatacatttttgtgtacttccccaattatgcttgtcttgctagaataaacttcgagtagttgaagtattgggtcagataaatttttttttgtattttgttgagtatactctttctgaaggatacgccagtaccctgagtacccgattttatataaccttcccagtattagaattaacacattttgaaacatctttttgcctattgaacagtttattattttcatttatatatattcttgggcatgttttcatatgtttattgactttataaatttcctctttggagactgattcatatattaactgttgcccatttccttatttgcaggttagttttcttcttattgattttcaagaactacattcgactgtgtcaaatgtctgtgatattatagatactcccaagagtgttatttgtctcttttgggtggtgccttttgctacacagaaattgctgtgtttcatacagtctaatctgtcaatcatttctttatgacattcagtttcttgccttgttagaaaaacttctcccatccaaagcttagctgtatttcttttaagacttgtctgattttattttttacattgaaatgattgtgctttttggattttactttgatgaggaaaagcactttgtaatcaagattcatgccattctacatttatttttgtttttatttattgatttttgctgttttatactgattttactagtgtctctcttgcttcttctagggggtctttaaagctgtgttcttggacatagcccaccctttctttggtttatttttttaaatttgttgtgtgtggttttctgagattggttccatccttgggtaaagcttttgggcctcagtttacttgtggcctgtcatcctcatgagagatacaatcatttttctgcctttacaccttacatctctttctttttttgtatattgaggttagtggattgcctgctgtgatctcatgtcttgtcccaagcttgcttccagcaaaaatacttcccagtttcttaggtgacctcagatggtgccttctccaccagagaattcagtttacacaatcctttttctttttttgagaccaagtctcgctctgttgcccaggctggagtgcagtggcatgatctcggctcaccacaacctccgcctcctgggttcaagcgattctcctgcctcagcctcccaagtagttgggaatagaggcacgtgccaccatgctcagctaatttttgtatttttagtagagatggggtttcactgtgttggccaggctgatctcgaactcctgacctcgtgatcggcccacctcagcctcccagagtgctgggattacaggcgtgagccaccgcgcctggccaagtttacacagttctatagtagaaaacatacaaagctaacagtggcagttgtacatggttagtaaggagattgtccctatatcacatctcccagggtactgagttctggtatataatgtgttttctaaatcagttatgtttttaaaaaatcataccttgtaaatgactcgtgatttctcatacccagaacacggttgtttttaacaggcctttttaacgattgtagaatcacctgtgttctttgtaacaaactcaaataagatagaagcacatgaattaattcccttcttttcttgcctctaattcagagctcaaagatgaccagccacagttacttatctttccagacttttttgtgcttgtacaaatagttttcttattcttttaaacaaaagcagtatcgtattttacaggttacagaattctcttcgttttactgtgtcttgcggatgtgtcccttggacctgtctatatacataagtcgtgctttccttcaagttctcctcttcgttagcttaggagagccaagaaataaagactttcttacaaatgactgtttgagtttggctgatgtgtcctacagaaacctcaccatctctctctctgttctccctactctcttacgggtccttacctactaccatggcttggattatttttgtgtattctcatggcttccaactgttttacatctgcagtggttaattctcttgtcatctttacctgaagatcataaaaatgcctttctccctcttacccaccctttctgtgttactcaatattgtattttaactcccaagcctacagtttacccttgaacaacacaccaacacggggattggggctgtctgctgggtggcacctgtgcaatggtgactgggttctggctgtcacatgtgcaacagtgtgtgtgctgcagctgtcaccagtgcaacagtggctgtgttccaactgttccctgaagttttagccaaggtgatagtccgttttgtgtcacgttttgacctgatttatttttgcgatgatttgggattgtgattggataccatccttatgaatactgttttcttctttaaggaaagggggctgtatacagctttgatccagtagggtcttaccagagagactccttcaaggctggaggctcagcaagtgccatgctacagcccctgcttgacaaccaggtaatgatactgtgtccaggtaatgatactatgtccaacttgtcatggtgttcagttgaagtgccttcctccaagttctcctcttcattagcttaggagagccaagatataaagactttcttataaattactgtttgagtttggcagacgtgtcctacagaaacctcatggtctctctctgtgttctgcctactctcttgtgggtccttacctactcccatggttttgattgttttcctgtattctcatggcttccaactcttttatgtctgtagtggctaattctcttgctgtctttacctgaagatcataaaaatgcctttttccctcttaccccccctttctgtgttacccaatactgtacttgaactcccaagcatacagttgagccttgaacaacacggggattggggcgccagttccccgagcactggaaaatccacatataactttcgactccaagaaaacttacaaataagcctactgttgactggaagccttgccaataatgtaaactgtggattatcacgtattttacatatgtattatgtgctgtattcttatgataaataaactacaggaaagagaatgttattaagaaaattataggaagagaaaatacatttacaatactgtatttgttgatactgtaagtttacatcatctgtttacaaggagaatcatctgtctggagtggtggacaaccacagctgcagacctcaatctacagtacatatcaagcaattcagctttttcttgtgatgtcataactttccctgcttcttggggagcagttccagcatcactaatagtgctttgtttgggccacttgttatttaaggtttataataatcgcactaaacacaatgaaaaacaaaggagaacattgagagatcactttaactttttataatcagtttatgtgtattttatggtagtaaatgataaaatagctagtatctacatacagtttatacatttgtggcatacctttctcttaatttttaaggtatttttaggctacttggctcatctgagtttttcaaagtgttgcgagtctccaaaaacttctcagtgtgtttactgaaaatttatgtgtcagtgggcctgagtggttgaaaacggtgttattcaaaggccgcctgtatttctaattcgtccctctttgtgattactgctggctaaattcagacctacattattagattattggatttatttcctaacatcctttctgcctacaagtttacttccctaattcctcctgctcagttttctgaaggatgtcatatatagctactcctctgcttattgcttattgacctcatctcctgtcaccccactacacccagaccctaactctgcttttctcagaaaagatgtgcttttcctaactccgtcccacatcttcagtctggaatgttctgtgctcttcagtgtagccttcagcgctcacctacttaaaagtcctttctgctgaagcctgtcttcttctaggagacttagtggacatctgttggggctctcctggctcttattttcttcttagttatagcaattctctgatcactttgcttgcatacgtccacctctccgggtcatgtgcttctcaagagtgggagctttgccagggaatcgttgtcagatttctgatgtgtgtaattcatccaggtctggaagggtctttattcagtctgaaggacattttaattttgtatagtattttcatcacaaatcctcgtacacatgagggtattggaagaaacttgaacctttcctttgtgctcactgtcacatgacatctcacccaagtttcatgtcccaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactcattttgctataacttgtcttctctaagcaggacagatataggaagtagaatttcttttaattttcttcatttttcccacccttttctatttttctgagatttttttttttttttttttttttttttgcattttaagtaatgaaaacaggtcatgttaattttcccttacactaatgaggtaggaatttctctgtaaaagttgaccttttgagcaaacttatcttatgaagagggctctggtgtttacgcagccagcttgcctgaagggacctttaaaccatccagaagggagagtatttactagggttttattaagactctaatggttataaatgaaatatcttaagatttttcacttctgggactgttaagccatctggaatagctattttggagaaaaatcttcaaccaaaataaaactgtaaaaaaaaaaaataggcctttatacaagctgtagccagaaatctgggataatttttacaagcactttagtaatgttataattgagacctaagttttgatagagccaaaattttttagatctattaaatacattttaactccattataatatttgagtaattttcttgttattgaacaagtcaaattatatgtaacatgggagttattgtatgctttgtaccagaacaacctgtggtataaatggaattttactaagttagtggttaatcttagataccacttttgtttattttgccttttataaataattcaaattatcgaaagctgctagtagatacacattgtaaacatttattgcacaaacatcaatactgtcactcactatcccaggcattggggacacagtggtaacacctggttcatctcttaacagtgtctgtatgaggattctccaaagactcagaaccaataggatatgtttgtatatagagagagatgagaaagggtttattaaagaaattggctcactcagttattgagactgagaattcccatgcctggctgtctgcaagctggggagccagagaaactggcagcatggctcagtccaagtctgaaggcctcacaaccagggaagctgatggtataacccttgaagtcctgaaaataaggagttgggtgtgaggggttgctaatcaagtccctggctcgaggagaaagacagtgaattatttgcctttgccttttggttctatctgggctccattcagttggatggtgcctgctcacacaggctgatctgcactcagtccacaaactcctaggccagtctccggaaacatcctcacagacaaacccagaagtaatgctttacctgctgtcttgatatcctttaatccagtcaagttgacacctaaaattaactatcccaatgtcccaactaaaaactgtagagtatcccaatttcaaatctacattttttcttctttatatacactaggtatattcttattctaaaggatttcccattttggaattttctgtttatataaagttgtgtatctaggattttctataaggttctcacctcccaaggtgtatagggaagttctacaaattgagtaatgattgatggcacataattagtgttccatgatgtttttttacaaccttcagctaacattgttttaatccagtattgctgtagactttgaacatggtcttagttttggagtgaacacgacttagtccagaatgtgtttggcatatggctcctagagctaacctggctactagttatttgggtagttttatagatcattcaggcacattccttgtgtgaaaagaaaacctttgataaacattagaagtatgattcattcttaagagttaggcttgaagattccagtgagaagctgctgatgtagagactttctcttcattactgcctgcaaggggattggaagtatctggtaatattacaagtgattgatggaaaactgcttgagaggttggccatgactccatttatacacacagaatgcacgtagatgtttggat

SEQ ID NO: 14360 - DNA, 20316 bp, Human
acatagtctggtgtcttcccctaagatcgtatgaatttctggaagggtttatgttctcagggccacactggtctccagacttcttccatgtacactgccccctaattcctttctaaggtcacacaagcatgaaatcggattctacatctattgctaaaaacaagccccatttccatgaagcactgaagaattgagtaggctgaaactggaccaagatcttccatcacaataatataaaaacctgcaaatgtgatggcaggtatcaccattcccacacatccagcacccacagtaagtattttcccaaccatcatcactctccgcacctacagtccccaatgctttgcatctcgtcagttctcttcctgatcattccacctctgctttccctgctcttttatctctcgccctacttcacaggagtaagcctcctagtcctacacagagcaatttactcagctccctgaattatctaggaatttccccaaagactagagtttgtggagatactttcctttaggtttagagagcattgaggagcttaagtaccatgggttgatgacagacgtgacaggattctgggggcagtctgcccttccagatgcataatccttttggatagggcaagcagacctgtggacatattagattcctataattcatataattttagggctgaaaaggtctttatggggcacccttacgttgaagaaagtaagccctggggctctttagtgacccaccttgggtcacattgccttctacaaactctgtgcttgtagaaaatagactttcaaccaaatgttcttggaacataatctttttttttttttttttttttttgagacggagtctcgctctgtcgtccaggctggagtgcggtggcgcgatctcggctcaatgcaagctccgcctcccgggttcctgccattctcctgcctcagcctcccgagtagctaggactacaggcgcccgccaccacgccgggcaaatttttctggattttttagcagagacggggtttcaccgtgttaggcaggatgttctcgatctcctgacctcgtgatccgcccgcctcggcctcccaaagtgctgggattacaggcgtgagacaccgcgcccgtccggaacataatcttttaacgggttttcacatttggatttctagatacagtaagtagccagttattactttaacgtcagaaaaagatgtctttaatttttttgtactctgtagtagaaaaattacgaaagaaggtacttgaaaacactaactgtatatttcctagaggaaaaactggcaaaggcgatcttcacaaagggtggaccgtaccttatacatcaaacccaacgatcccatcccacactttacattcagcttaaccagaagtaaaacctcttgtcacaccgtcaccggtattccaattatggcaataacgatctccttctacggatgcggttgacagataagatctctaaaccgctgctaatcaatcggtcctggctcaagcatttcttatctgccggattcagaaaatacagatgctggaagctcaccggcttgttcggggaaagaacgctaagcaagaataaaattttatttcaaagcgccaaaaatctggaattctgaggtccacagggaggtttcccagagcaactcagttgttcccttctgagaacgtagctccgtgaaatgcacatccctactcggtccagagaaatagatcaatggggaaaaggattgaatcaaccaagtaggctgggcgggagacagccttaacccacgggcgcgggcgagtcgtatgggcaggggcaggcgggagcgacgtggggcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccaggtaggtccggggctggcgtagcgggtgcgctcctccagtgctcgagttggcggggcggtggccgccggggcccacgcccatccccgctggcgagggtccagaggtttggactggcgggcagagccggcccgctccgggcctgacttggctggttgcattgacccgagctgagccctgccctggggaagcgagggttggccgcgcccggtgctgcaggaagagccccaggcttttcggcctcggaggtgcaggtttggctgggtagagcctgtctttctggcggcgtgtctcccaccccacccccaacacgcgagtcggcggtgtccaggagggaaggaacgggaaaggtggttctgaaggaaaattgcagtaaaagagctacagttctttggatcccagagggccttgatcctgggtataccttagagaaatcctgggagtctcttacgtctagttcagtgtgattttaggttactgttcatagttggaagaggtgggagagatggagaggtctttatggagtaggagtgtgtatataaatacagcaaatgaaggaacgacaattaagggaacagtgttttttataacctgaaatagcttgtagctcaatgaatgcctcagatgacttgatttatccccattctgacttctctgtcaatttctaagggaacaaaatttaatgtttgtcaactcatatgttaatacggcttttaaaacatgtatcatcctccagaagttattcataaatctagtgaacaataagtataatctcatgcacagaagtaatattgtataactccagttttggaaatggatttgaatgttagcgatcatgaaacttgtttgaactttatgaattatttattgaaggttaataaatttatcagtttatcagtttatcagaagtttctgataaacttaattttttatcaaatttcctccatgaggaagaaaaggtaggacattataattggagtgaatgttctgtgctacgaaaacaaagcttattatctctgacggtaaaatggggtagttgattccttaaggcagtggaggaatttgattgaacagtaaaagaagtagcattgtgttagtccaattggctgctactgcaagaaactagatcatggtccatgcttggaatggcacattctatgcctaaatattgatggaatatgccttgctgctcaccaaaaaatacttctactacatttttaatgtataatatctggctttcattgtgtaggtcgtttttatttttgttttgtttttattgcaagtccttgttctatataaatagtgttggaactgttctaaccctggttatttggttattttagatgttttatttacatcaatgggagattgttatacatcacaaaagttatttagtcattgaataacattttcgctaagtaggaacagcaatcatttttcagcatgaagatacagcgttgctttcacttttgatctgacaattattagaaagtgaactgaagaaaatgtcagtatgcagtttcctttaaagatgggaactcgctatgttgcctgcgctggattccaactcctggactcgagcaatcctcccaccacagcctctcaagtagctgggactacaggtgcactactgcacccagccagggtacctttctgataaacttaattcaacccaaattaacactttgaaatcttatgtaatggtatcattttttttttcctaagttggacaaactaatcaatgatacttgtttgttgatgtttgtatttttgatgagggtctgaactttaaaaaaaaaaaaatggcgatctgtcatacccaggcagtttgattccagagctcttactttaaccatgagattaaagtcattgaaagttatggggtaggtaggtgacatgatcagaattgtttattaagacgaatctggccccatcgtagtgtgggttaaaaaggtaagcagttttgctttgaagaattattttaaaaattctttttgcctagtaataatttgaattttcacatgtcatagcagcaaagattgttgagatttagtaatgccagtattaaccataccttgttgtggggattataaaattagtataactttctagaaggcattctgacaataagtatcagaattttaaatatgtattctctttgatccagcaattccacttctgggaatttattttaagaaaaatgctcagcaatgtgtgcacaagaatttttattgcagcaatttttttattaactaatttcgttatgtgcaaggaatatgctatatgtatattatacatatgttcattttattaaactatgaggcataataaaatgaacatccatgaacttaccacctgaactcagaacaagaatattaccagtataattgaagttaccagtttgcagtattattttacattagcaaaaaaatgaggaacaacctaaatgtccatcagtcagggatttataagtaatagtacatctagccgggcgcagtggctcacgcctgtaaccagcactttgggaggccaaggagggcggattacctgaggtctggagttcgagaccagcctggccaacatggtgaaaccccatctctactaaaaatacaaaaattagctcggtgtggtagcgcgggtctgtagtcccagctacttgtaaggctgaggcaggagaatcacttgaacccgagagacggaggttgcagtgagctgagatggcaccacggcactccagcctgcgacagtgagactctgtctcaaaaataaataaagaaataaagaaataataaataaataaataaaaaatagtacatctacatgatgaaattcaatatcggtatttaaaggaataaggttgaactatcatactttatcaattctgaaataccactaaatctaagataagccatctatttagtagcaattttttagcaggaagaaagtaaacataaagcttttattaataatagcatacatttattcattcaattgtataccattttcgtctgtcacaataaagtttgagtctcagccttattcacattcagaatctaggatccttctgaattacttcggttagttaatgcaacatcatgataacaggctgcttttcataatgctagttaattatcttaacctatattgtctttatgattgtgtgtataattttaaggtatattgaagaatactggggttttgcttgcctttcatttttgcttacttagtttttttttcttcttcttaattgaattacctattgctggaaattaaacagcttcttctgaagataactccaaaagttttggcagacttttgagtctgtcttacctttgaaaattctgtgatcttgcttgaatttaataattacttatgcctttaattgcattgtctattgaatgacagtttgagtgcacaatactatgtcacaatggaatctttcagaacattttgtggaccaggcatggtatcatcccagtattttgggaggctgaggcaggaggaacacttgaattcaggagtttgagaccagcctgggcaacctagcaagatctccatctgtatttacaaaaataataatagctgggcgtggtagctcatgcttgtaatcccagcactttgggaggctgaggtgtgtggatcacatgaggtcaggagttcaagaccaacctggccaacgtggcaaacccctgtctctactaaaaatacaaaaattagccaggtgtggtggtgggtacctgtagtcccagctactccggaggctgaggcatgagaatcacttgaacttggaaagcagaggttgcagtgagccagaatacgacactgcactccagcctgagtgagacagtctcacaaaaaaaaaaaagtaataatgataaaagaaaaaaagaggccgtgcgcagtggttcatgcctatataatcccagcacttcgggaggccgaggcaggtggatcacctgaggttaggagttcaagaccaccctggccaacatggtgaaaccccatctctactaaaaatacaaaaattagccacacatggtggcacatgcctgtaattccagctacttgggaggctgaggcaggagaattgcttgaacccgggaggcagaggttgcagtcagctgagatcacgccattgcactccaacctgggcaacaagagagaaactccttctcaaaaaaacaaaaacaaaacagaaaaaaagaaaaaacattttgagcatcatatatggtgctgccaatgaaaatattacaattgtccgggtatggtggctcacacctgtaatcgcagcactttgagaggccaaggcgggtggatcacccgaggtcaggcattcgagaccagcctaggcaacatggagaaaccccgtctctactaaaaatacaaaaaattagccgggtgtggtggtgggctcctgtaatcccagctacttgggaggctgaggcagaagaattgcttgaacccgggaggcagaggttgcagtgagccgagatggcaccattgcactccagcctgggcaacagagggagactctgtctcaaaaaaaaaaaaagaaaataatacaattgaggtaacagagatttcgacttttatgtatggttaagttaggcatgtgcaatgactgctactctagaacttctctgctttggaggggagattggaccttgatttatttggaaggaactctcatccattgttttcattatcatactcggccacctgtgaagtgtgtgttgggtgagtattctctctttggaaggtacacatctttctcagctagcttattgctcatagaagttgggggcccaagggttgatcttaagatatactcaatttatttatttatttattttttctgggacagagttttgctctgatgcccgggctggagtgtagtggcacaatcacagctcactgcagcctcgacctcctgggctcaattgatccacccacctcagtctctccagtagctgggactgcaggtgcacaccaacataattggctgattttttctattttttgtagagttagggtctcactttgtttcccaggctagtctcaaacacctgggctcaagagatccgcccacctcagcctccaaaagttttggaattacaggcatgagccactgcacccggccctaacttttagaaatattaaaatgtagaaaagcatgcttagaatcaaacaaacatgatactggccgggcatggtggctcacacctgtaatcccagcactttgggaggctaaggtgggaggatcgcttgaggccaggagtttgagaccagcctcgtcaacatagcgagaccctcatctctattcaaaaagaaaagagagaatagaagataaaatatggctgggcgcagtggctcacacctgtaatcccagcactttgggaggccaaggtgggcggtcacctgaggtcgggagttcgagaccagcctgaccaacatggagaaactccgtctctactaaaaatagaaaattaaccgggtgtggtggcacatggcctgtaatcccagctgcttgggaggctgaggcaggagaattgcttgaacccgggaggtggaggttgcggtgagccaagatcgcgccattgcactccagcctgggcaacgagcgaaactccatctataaataaataaataaataaataaaagaaacatgacacctaactgtggaaagatgttcacggtattatgttattcttttgctaagaaattgggccctgattagtgacagaggcaagattcatgggtcctattatccacatgcccaataatctcttaatcaggtccagatatggttcctcttggtccagggacctgtgaagtaatgtgtcctgtgtgctgcgtgtgtgcgcactctctctctctctgtcactcactgtgtctcctctctatctcccttccttttcttttccccttactcactcaccgcagtacacaagggccacagtaagcgctcttcctagaaaaagagaataatgggagataagcagcaaatgctgatctataatctgaaatctcctaggcagattctgtgtaagcaaccgggcctggaggtaggggagattggaccctgatttatttggaaggaactctcccatccattgttttaatgatcatccttgaccacctgtgaagtgtgtgttgtaccttccctttggaacgtacaaatctttttcaactagcttcttgctcatagaagtcggggacccaagggttttaaattttgaatagacaagaagatttttttagtatgaacttgagatgatttaagaaaaaaaaatttcattttgttttttgagatggagtctcaccctgtcacccaggctagagtgcagtggcacaatctccgctcactgcaacctccgcctcccaggttcaagcaattcttctgcctcagcctcctgagtagctgggactacaggcacatgccaccacgcccagctaatttttgtattttttagtagagatgaggtttcaccttattggccaggctggtctcaaactcctgacctcgtgatccgcctgtctcggcctcccaaagtgctggaattacaggtgtgaggcaccgtgcccggccaaaagatattttttttttttttaacaaaacagtttctttaaagttagtaagcctcttccgatctgtttggtttccttcagttctatgtgtcagtaaccacagtcgaagttcacatgtattggtaaactcatccaaagatttaagagcgtctattcctcctcctctcatttggttgtttgaggctattaggtttgatgggaaggctacgtctttaatatggtcttaaccacagaagcactagttagctaaggggtttcagtgggcatctgtgctcagtcttttaatcctgcctctaggggtctaggtacaagctgcttttccaatccttcaaggctttaaatttctgaactttttctattctcttctgtttttgctttcaaatctactacttccttcttgaactcatcatttacttataatacttgccaaatatctaatagcagccaatactcacttccaaaatcctctttaccaaactcctataacactacaaggtcagtagcctctttgtatgttcactgaccttgtagttgtatgaaaagttattataggcaacagcgttaccagatattttgccactataaaacatgatcctccatctttccagcctccggtatctgtttcctctcagcccttaatctgaccactaaggcagtatcactaaggcaggactgcataggtttttattgtagcagcacctcacttccaggtaccagttttctgtattaggataatgaaacactgaatatacagatggacaatggccagatcatatataaaactagaactctgacccatgacctatgtagcaataggcccagtcaggacttggtcagtaattaccagcttccctaatttttgtgccttcttccaattcgggacgactcagagaaagccaaatatgcttcccaaatcaaccacataggataccccgcttccagtgtcgacgaagagtcaaactctgtaaaatattttaagagatctattctaagccaaatatgaatggctattgccccatgacacagccctcaggagctcctgagaacatgtgcccaaggtgatcagactacagcttggttttatacattttagggagacataagacatcaatcagtatatgtaagatgtacattggttaggtccagaaaggaagacaccttgaagcagatggcttccaggtcataggtagattcacagattttctgattggcagttggtcgaaagagttgttactgtctaaagacctagaatcaatagaagggagtatctaggttaagataaggggttgtgggcaggcacagtggctcacgcctgtaatcccaacaccttgggaggccgaggcaggtggatcacgaggtcaggagttcaagaccagcttggccaacatagtgaaaccccatctctactaaaaatacaaaaattagcgaggcatggtagcgcacgcctgtaatcccagctactcaggaggctgaggcaggagaatcacttgaaaccgggaggcggagattgtggtgagccaagatcaagccactgcattccaacctgggcaacagagtgagactccatctaaaaaaaaaaaaaaaaaaaaaaaaaagataaggggttgtggagaccagggttcccattatgcagatagaatcaataggaaggaatgtctgagccaaggtaaggggttgtggagaccaaagttcccattatgtaaaggaagcctccaggtggcaggcttcagagataatacattgtaaatgtttcttatcagggttgattctctcctggatcaggcaaaaggcctgagaaaggaagggaattaacttcagaatgtagattttccgcacaagagacagctttgcaggactgtttgaagatatggcaaagaaacataatttggggtcaaatacttggatttctttcagggcctgccatctgtcatgtgatactatgctagagtcaggctggaattgggtatcttattgctacagagagtctgttttgtcagtcttaagatttgttttaatgttagtgctggtcagctgtgcctgaattccaacagggaggagggaataatgaggtatggccaaactccgcttcccatcatggctggaactagtttttcaggttaactttcaaatgctcttggctgggaggaggggttcattcagatggttgaaggacttagaattttatttttggtttacatcagttagcccacctccagtttcccatgccaacaacctacaatcagagcatacctgatgtcttccccctttttttagtataaagatttcccactcccctgcttgcctttgaatctttgccaagcacaagttgacagtggctgactccctacctatatagtaagatctaattaaatagcctttgtttgtttccatttgggcagtctttgtctattttcacaatgttattaggctgttttgtggtaacaaatccccaaatatcaatggcttaacacaacagaaatgtttctcttgctcagagttcagtgggagtcagtagggttctccatccagtggcttagggatccaccttccttccatattgtcaagccaccatctcagaatgtaacctacattgtcattaaagcaggaaaaccgaagcaaagtgacttttaactgcctcagtccagaattgagatatgttacatctgctcatccagctttggccaaatctgggaaatggagtcgagtactgtatgtgaatatagtctctgccagaatatatttaccaaaagcaattggctaaagatatacacaattcctccatttcagcgtttttgagatcagaagatttagattatcttacaattgaaattttttttttttttttttttgagatccagtctcgctctgtcgcccaggctggagtgcagtggtgcagtctcggctcactgcaacctctgcctctgtggttcaagcgattctcctgcctcagccttccgagtagctgggactacaggtgcctgccaccacgctcggctaatttttgtgtttttagtagagacggggtttcaccatattgaccagggtggtcttgtacaattaaaattgaaatgaatattcaaatgtaatgcttctgttatttcccctgataaatgaagtgacattgtttcatggaaataatagtttctttaaaatgaatcctgtgtattttaattgcatgtatttaaataagaatttgtagcagaaccattctaggatccagtcatttcctttcctttttttttcttttttaactctctattttggaaaacttcaagaatacacaaaagtaaagagaaaggccaaggcagtaggattgcttgatgccaggagttcaagactagcctgggcaacatggtgagcccctgtctctaaaaaataaataataagaagaaagagactagtacagtgaaccctcatatacccattactcagctacaacagttttcaacaaatgaaaacttctgtctcatttatatccccaaccccttcagcacacaaccaaattattttgaaataaattccagacattatttattttatccacaagtattttcaacatgtagatgatagaaatatgcttaaaataagttttcagttatttaaacctaaaacacattgttacacatataccagaactcagtcctttctctgacctttgtgcactcaatgttaggagttacatcagcctataggactagagaatgaatttctctggtccagcgttttctaatgtatactacatggaatgtaaatctcatgaaatgttatggggggaaaaggtaagataagataaatttgggcaacaatacattctcttcttgtcttgaattccttgcctcaagtgatcctcccacctgggcctctgaaagtattgggattacaggcgtaaacccccagaccccattgtcttctcataattccccatgattatgtaaaagaatgagatgtccggccgggcacagtggctcatacctgtaatcccagcactttgggaggccaaggcgggcagatcacgaggtcaggagttcgagaccagcctgacctacatggtgaaaccccatctctactaaaaatacaaaaattagcctggcgtggtggtacacacctgtgatctcggctactcaggaggctgaggcaggaaaattgcttgaaccagggaggcagaggttgcagtgagccaagatcaccccactgcactccagcctgggcaacagagcgagactccatcttcaaaaaaaaaaaaaaaaaaaaagagatgtccagttttgtgtattatgatcccattttggttaatagtagtatatgttagaatattcagtattaatagtgattattattagtttcctgtgtcttatgtaacaaatcactataaacctggtggcttaaaacaacataaatttatcctctcacagttctggaggccagacgtttaaaatcaaggcattagcaaggccagttttcttccacaggctctaggagagaagctgtcccttgccacttccagcttctgttggctgctgtcatccttggcttctgacttcatcatcacattgccttcctttttctgtgtgaatcagacctccttctgcctctcaaaaggacacttgtaattgcatgtgggacttactctgttaatccatgacaataacttaatctcagaatccttaatcacatctgcagcatccctttttccaaataagataacatttacaagttccagagaagattaggaaggggaatatctttttttttttgagacagggtctcactgtctctcctaggctggagtgcagtggtacagtcatggctcactgtagcctctacctcctgggctcaagtgatcctcccacctcagtcacctgagcagctggtaccacagtcacacacactgccacactcagctcattttttgcagtatttgtggagacggggttttgccatgttgcccacccaggctggtcttgaactcctgagctcaagtgatcctcccactttgggcctcccaaagtgttgggattacaggcataagccaggaatatctttttttttttttttttttttttttttttttttttttttttgcgaccgggtttcgctcttgttgcccaggctggagtgcaatggcacgatctcggctcaccacaacctccacctcccgggttcaagcgattctcctgccttagcctcccgagtagctgagattacaggcatgtgccaccacacccagctaattttgtatttttagtagagacggggtttctccatgttggtcaggctggtctcaaactcccgacctcaggtgatccacccgccttggcctcccaaagtgctgggattataggagtgagccactgtgcctggctcaggaatatcttttgagaggccattattcagcccgctacagtgattctcactcttgaggaaggtgaattatgagggacttctactttttcctactgtatatatttatataaatacttgaatttttcaataaggatgcatgctgtatttttttaacagcagaaagaaggggcaagttacctgcatttgtaagttcaaatatttttgcgctacctactggtgaccaggtcccattatagggaaatggaagcaaatattttgacagaagcaaaactatgtttcttttctttttttcttttttttttctctctctctctctgtcagaatgatcttggaaatggtaaaataacaataataataaagtgatgattaacttagagttgaaacccaaagtaagtgagatattgaaagaatacctagatcctataaatgaattgcaatccagatactaaaagaactgacatgtaagattccacaacagtgttaatccttgatcatggagaaatggtaggtttcagaagacctaatatagaaagtatcttcacttttagaaagggccagaggtgaattctgcaaactttagactggcgagctaaatgttaagcttagaaaaactcattagtaagctattaaattaatattttgggaaagcttagaaaagaaaatgctttagggaccagcttccttcataaaaagcacatggtatgtccatcctaatttcatttacaaaataattatattattcatgtattattatgttatagatagaatatgtgcaattttcaggcaatgaaaaagttcatctttttttttttcaaagtggagaaatgtgagctgcttgtaatagagtttgattgattcatagctaatttagcaattgtgccatgagagcactgatttatgaggtgaagtcatcaggaaactacctctagtggctgctacagggcttcgtcatgtctcaggcctgctgcaaattgtgtgtgtgtgtgtgtgtgtgtgtgtgtgtgtgtgtgtataattaatttctataaatataaattttaaaaaattaaaaatgggtatatttttaacagctttattaacatacaatttatatactataaagtttactcaggctaggtggggtggctcatgcctataatcccaccactttgggaggctgaggcaggaggcttacctgagcacttgaacccaggagttcaagaccagcctgagcaacatagggagactttgttttacaaaaaattaacaacttagctggacagggtggcatgttcctgcattcccagctacttgggaggcttaggcaggaggatgagcacaggaggttgaggctgcagtgagctgtgatcaaaccactgtactccagcctgagcaacagaatgagaccctgtctcaaaaaaaaaaacaaaaaaaaaacccctaagtttacccatttaaagtgtttttttagcatattttcacagcaataaattgtaatctaattttagaacagaaaataggttagttttgtatacagtatggtgaatttgctttttttgcttaggatacatttacttatctgtttatatctgtacattatatagaactacatcattctgccggccacagtggctcacgcctgtaatcccagcactttgggaggctgaggtgggtggatcacctgaggtcgggagtccgagaccagcctgaccaacatggataaatcctgtctctactaaaaatacaaaattagctgggcacggtggtgcatgcctgtaatcccagctattcgggaggctgaggcaggagaatcacttgaacccgggaggtagaggttgcagtgagccaagatcgtgccattgcactccagcctggggaacaagagcgaaactccatctcagaaaaaaagaactgcatcattctttttgacttagatgtatattatataaatgtactatgaattacttgaacaatcctccactgatgaacatctggactggtgtcaacttttgctgttataaatgatgttgcgaggaacagcctacatcttcacatacttgtgtgtatattcctttacttgtgttgcattgttcctcttaatcctagttcaatttattagatgttgataaccactttatgtctcaggagtcagtttcagagaattaaatgtccaagtccacattgctactaattaacagaacaagtaatttttttttttaatgtagacagggtctccctatgttgcccaggctggtctcaaattcctgagctcaagcagtcctcccttcttggcctcccaagtgttgtgattataggcctgagccaccatgcctggcccctgaacaagtacttgaatctcattttttgttgctgctttccattacaagtgctgtgcttttctagtactcagagaagtactgtatatccagctaagccattcatgagattcatccacaagatccaaccacctcccaccagaccccaccttcaagagtggggactaaagttcgacatgagatttggtggggacacagatccaaaccatatcagagtcctagttcatagcttggaaaataaactcaggcatctgtttttgaagcataaagggaccttctggaatagtggtttaaaaatctttttaaagtggaggattgcagtggctcaagcctgcaatcccagcactttgggaggccaaggcaggtgaatcacttgaggccaggagttcgagaccagcctggccaacatagtgaaaccccatctctactaaacgatacaaaaattagctgggcgtggtggcagacacctgtaatcacagctacttgggatgctgaggcatgagaatcacttgaacctgagaggcggaggttgcagtgagccaaggttgcaccactacactcctgcactctagcctgggtggtagagcaagattctgtctcaaaaaaaaaaaggctgggcacggtggctcacacctgtaatcccagcactttgggaggctgaggtgggtggatcatgaggtcaggagttcaagaccagcctggccaacatggcgaaaccccctctctactaaaaatacaaaaaaagttagctgggcgtggtggcgggtgcctgtaatcccagctattggggaggctgaggcaggagaattgcttgaacccaggaggcagagtttgcagtgaggcaagatcgcgccactgcactccagtctgggtgacagagtgagactccatctcaaaaaataaaaataaaaaaataaaaataaatttaaagcaacaatacccttctaaagaaatcttgaagtctgatttgtaaaatttaaaatttgatcctctaggtgaagttgttaataagaggttacctgttttattgttcacttaataatccctggcatttgtataaatgcttagtatgcttactaaggaacttttttttttttttttaaatcatcatagctacgatttgaggtaaatctaggttataggctaggaagtaggcatggagagattaagtaacttgtcctgaacccggagtaatccttaatggagtcagaactataacctgaatctcttaacccctatatcaatggacttttcctctaatacatggtactgctgtattaaccactttatagctttcctttctttctttcttttacagagttaattatttatattgtaaagaattttaacagtcctggggacttccttgaagcatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggtaagaatgtttaaagacaaaagaaaggattcttcttaccttatgctacataacactttttgggtgataacatgccaaaatgtttcctttgggagaatttaaccctgtatacacatttatgtattctatcagcaaagaatgttacgtttataattccattaattactattaaaaataatatttctttagtttcttctgtgatatgtatcactaaattctggagtttctggaatttaaaaggccagatcatgaagtcataatggaagtgcagttgaagaaagccataggtgagggtaggggaaggacatctgtttgtgtgaaatacaagcttggtgaactaagtggctgttggggaaatgatagttccaaggatatgaaatttaactttatagtagggagaaagaattatagttaagagtttgtgtaagcagttgtgttctcaggcccaaatcttaaattcacaaaaactaacaaaatttcacttcaggctaactgccaagtctttaatatttctcttcagaattcattttgaagttttttcataacccatatatttaatcatttcatttaggttattaatagaattttcttcttatgataacataccttgtaagcatgaatattttaggtgtcaggagtcattttagatgggcaatgtaaaatttaagtaaatgtgaataatcaaaagttaggccaggccgggtgcagtggctcacgcctgtaatcccagccctttgggaagccaaggtgggtggatcatctgaggtcaagagttccagaccagcctaaccaacatggtgaaaccctgtctctactaaagatatcaaattagctgggcatagtggcacatgcctgtaatcccagctacctgggaggctgaagcaggataatctcttgaacccgggaggcagaggttacagtgagccgagatcgcgccattgcactccagcctggtcaacaagagggaaactccatctcaaaaaaacagttaattacatttttcaaaattatagtaatgttttttctgattgcaaaaatattacctattttctgttaacaatttaaaagtgtaaagaagaaactgaaaattatatttagcttcactgtataaagataactactcttaaaattccttcactgtttgttttttgttgttttgtgtgtttttttggtggccgaatttccatatatatctgtatttaatttaaaaaatgagaacctaagtatgcattgtagtaaaggatttgaaaagggagatttacaactaaactagaaggaaaaaaaagttttattttttatattttttgagacggagccttgctcagtcacccaaactggagtgcagtggtgcgatctcagctctctgcaacctctgcctcccgggttcaagcaattctcctgcctcagcctcccgagtagctgggactataggcgcccaccacgacgcctggctatttttgtatttttagtagagatggggtttcaccatgttggccaggctggtctcgaactcctgacctcgtgatcagcccaccttggcctcccaaagtgctgggattacaggcatgagccaccacacccagctgaaaataagaaattttatttctggcacattctgtttacttatttgattaatattattttctatcatttttacacttaagtgttctaaaaatactggatttggaccaggaaatagagagaggaggaggagggaaggacctgggataatgtttttctcgttagtatttggaggattaaagaaatggcttgagtggagattgtcccaagcactttcttcctaatcccttagccaaaaggcaaagtataattattgatcttattctttccttttacatattgctaagcaaagagaagttatgaaatcacatagctataaaggccccaagtggtaatgtgttatgtcagataagtcacccagtaatatgtatttatggagttcttactatgtgtgcaccccacccatcagtcaggatagtgacatg

SEQ ID NO: 14361 - DNA, 13027 bp, Human
aatttgagcctgagaattccaaagtctggaggagtttttctgccatgcttcaattcaacatattgaacggtttgaacagaattgtggatggcaactccagcagttgctgctgttgcagtaaccgcaattagtcctgcaatgatggcaataagagtaaaaataaatctctttgttcttttgcggatacctttaagaacttcattgactatgtgaatagagggggaagactcccatggacgatgtaaagaaactggtatccataccccctccctagcccttaccaagagagtacttgtagtgggattaaaagtagcatcaatgcacgtgaacagcttacagttatcacattctatagtttgtgtattgggaatgataattatatttccaaccaacagcatgtaagggggtttgacatagctcctgatgggtatcacccgttcagatatgagggtgatgttgaatgtgggtgttttggtattagtgtgaaggagttgataggtagtgttccatatccttattcctgtcatagctgcagctaattttcatagttgaggatgttctggggtaacaaagggatgaatcatttttggtctaggaggagtaatgcctgcatccatccatttaaataggtaaggggacacccattgtctcagcctgtatgactgccatccatcctctacataatctaacaaataattaaactctgagcatgaggtatttttgctggagcaatcttgccaataatgcccttttggagcccaatcaataacaatacctgcggctagactttggagcacaacggccttaggagcattacaattattccataaaattgaagtcactataaaaggtccctttgtaggtttctttaaccaaaagagaggctgggcacagttgctcacactagtaaacccagcactttgggagaccgaggcgggcagatcacgaggtcaggagttcaaaaccagcttggccaacatggtgaaacccctgcctcagcttcctgagtgctgggattataggcatgtgccaccacgcgcagctaattcttgtattttttcagtagagacgaggtttcatcatgttgcccaggctggtctcgagtacctgacctcaacctgaggtgatccaaccacctcagcctcccaaagtgctgggattacaagcatgagtcaccgcacccgggccccagtcactttagaatagcatgttgctttgtattcggagggtctctctgcaaatagcccatcaacactgagcgtgcctggaaagacctggttttcaaataactggcttcgtctgtgtaaaacgagtcttgttgtatgcattaaaaattatcttggctgggcgtggtggctcacgcctttaatcccagcattttgggaggctcgttctgttgccagggaggctgcaaaaggaggatgcggctatttctgcttccatcatggaaggctgggattccacaggcacagaaaggaaggagggagagatgggaatgtgactgtcctccagacacagcctctggcaggatcggatgtgggagagtgagggtcccaccccagctggggtctacccaggtccatgtcttggacatgttgagagtttttctggaaggcagggatacagtgtggtccaaaaacacacaaatgcccctactggcccaggggttgtcacaatagactggaagggtgacacatcccaggcgcttgccacccatcacacgcacctcctacccactggcatccttccaccccaggcacacacaaagcctcagtccagagatcaactctggactcagctctgaatttgcatatcctgtgtgtagattcattcttcataacctctgcccagcctagcttgtgtatcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtgagtggggaaagcaagggatgggtgctggagaggactggaaggaggtgaggaacaggacatgtggctgggagacaggctggatgcagctgggataccctggcatacggcaggaatgggtgcccaaggctgtcaactccctcagctcacacacttccaggagcattcagggagcctctgcgctggcccgaaataagaccttcaggaatctgaatctaaaacccctagtttacagtgaaaacaaagactccaaagaccaagcgacctgcttggggtagacagtcaggacggagtaggaaccatatgcctggagctgcttctgctcctgttccttccctccttccgatggctgggtacacctgcctgacgctgaggaaaagagagagcagccccaaggggaaagtgggaaggcaggttggctggagggatggtgctagaaggaaacccgtgcccaaatcccacactcagacaccactgcagtgggtctggaaggcgagtggctggaagagaagagagtgggagctccgggagatcaagagtcactcctaggataagggaaggaggctgtttgtggcatgagaatgtgcaggataaagacatggaagcgaatggcttctcagttgtgtgagtttaaaattcatgacatttacaaattgtcagaaaaggtgttatatgtttgttatataacaatcactttggaatgttaatctgattctgtgccaaaatctgaattactcagggttctccagagaaacagaactaataggtggtacacatatacatatatatgtacgtacacatacatacatacactgtatacacatggatacacacacacataggaagagatttacatatatgtatacaaaagagagagagagtagagatttattttaagaaattgactcacactattgggaggagtaacaagtcctaaatcttcagagccggccagcaggctggagacccagggaagagttgatgtcttagtcttgattccaagggcagactgtaggcagaattctttcctctttaggggacatctgaggctttttctcttaaggccttcaactgattggatgaagcccaccactatggagagtaatccactttactcaaggtctactgatttttttgtaaattaaaaaaaaaactgtgggtgcatagtatgtgtatatatttatggggtacatgagaggttttgattcaggcatgcaatgtgaaataatcacatcatcaaaaatgaggtatccatcccttcaagcttttatcgtttgtgttacagacaatccaattatacttttttggttattttagtttttaaaagtatttgattatttatttatttatttatttttgagacagagtctcactctgtcacccaggcaggagtgcagtggcatgatctcggctcactgcaacctccgcctcccaggttcaagcaattttcctgcctcagtctcctgagtagctaggactacaggcacctgccaccacacctggctaatttttttgtatttttagtagagacgggtttcatcatgttggccaggctagtcttgatatcctgacctcgtgatctgcccgccttggtctcccaaagtgccgggattacaggtgtcagcaactgcgcctggcctctcttttggttatttaaaagtgtacaattaaattatgattattattattatttttgagatggattcttgttctgtcacccaggctggagtgcagtggcgtgatcttggcttactgcaaacctccgcctgttgggttcaagcaattatcttgcctcgggtgtacactgccacacacggctaacttatgtatttttaatagagatagggtttcaccatgttggctagactggtcttgacctcttgacctcaagtgatccactcacttcagcctcccagagtgctggaattacaggcacgagccaccacacctggccccagttaaattattattgactatagtcaccctgttgtgctatcaaatagtaggtcttattcattcttctttttttttttttttttgtgacagagttgcccaggctggaatgcagtggtgcaatcttggctcactgcaacctctgcctcccgggcttaagcgattctcctgcctcagccttctgagtcgctgggactacaggtgtgtgccaccacgcccggctaatttatgtatttttagtagagatggggtttcaccatgttggccaggctggtttcgaactcctgacctcaagtgacccacctgcctcagcttcccaaagtgttggaattacaggcatgagccaccacacctggccccagttaaattattattcactggagtcactttgttgtgctatcaaatagttttctaactattttttttgtacccattaaccaccctcccaatttccccccaaccctgccactacccttcccagcctttggtaaccatccttctactctctatgtccatgaattcaattgtagggtctactgatttaaaggctaatcacatttagacactcaggagcaagaataattttagtaattgaactaggattctgccatatgacctccaacatcattagcacctgtgtaaattgtatcataaaataattatggaactattatggaaatgtccctctctcccagatcccaccttgtaccaaaatgcaaggtacaaccccgggaattctgagctccatcctagtcttaccctgtgctaattcagtctgggtcatttcttgaattttctggtaaattctcctttctaccctttctaactatatgtatttgtcaggttaagctagaagtgttaattttttttttttttgagatggagccttgctttgtcacctaggctgaagtgcagtggcatgatctcagctcactgcaagctccgcctcccgggttcatgccattctcctgcctcagcctcctgagtagctgggactacaggcacccgccaccatgcttggctaattttgtgaattcttagtagagacggggtttcaccatgttagccaggatggtctcgatctcctgacctcgtgatccacccgcctcggccccctaaagtgctgggattacaggcgtgagccactgagcccggacgaaatgttaatttgttttttttgagacggagtctcactctgtcatccaagctggagtgcagtggcatgatcttggcttgttgcaacctctgcctctctggttcaagtgattttcctgcctcagcctccagcatgactgggattacaggcccgcaccaccatgcccagctaatttttgtattttttaatagagatggggtttcaccatgttggccaggctggtcttcaactcctgatctcaagtaatctgcctgccttggcctcccaaagtcctgggattacaggcatgagccacggagcccagcctagaaatgttaatttctaacgcatgtcagattccatgcacactgggcaaggttccattcctccatggggtgactcagggatccaggccaattgcatattgagactctttcatattatcctgtggccttcaaagtcgtcacctctagggatgagaaacaaaagggacaagccagctggtagggtcttggacaagaagaaagacatcacttctgctcacattctcttttgacaaaactcagtcacatggtcccaatatatcttcgaggtggctgagtaatgttatcttcctatgtgtcaagcagaggaaataatgtagtgaagacacaggatggtctctgaaatatcatctcaggcatgaaagtagagcatattcacttgagtgagcctccagtggtgtgaagttgatggcaggagaaagagctggggaagaaaaggccagtggcaggtctcccctcctagccctatgcagccccacagtgggacccttgcatggacctcaaccatcagaatcttttcttttgcaggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagtcccaatcccaggggaagaacaggagacacagcagaaacacagacatgtccacatcccacccaccccacagcacaggtgctccccgcttccccatcaattgccccatcctcatcccaggcctcaggtcacacaggaagtgatggcagagtcacttcctatccaggcacctatgacctctcacctccacaccccacccatcggaggctgatacccccgtgagaaggcatcagactcacccctgtccagggaggttgcctggagagtgagccactctcaaagtcactcagacctgggctcacctggtggttctgccagtcctagctgttgacagtgaaacgttcccaaaatatctggttgaaatctgcaaacattggagcactgagacctacctccaaacaagtctgtaatatttaactatgtctgttctatgaaggatgtcacagtctgtcctgatctcccttgcagctccatcacctagcacagggtacagccaatattggctcaattgaaatttgtggaatccacagagaaaagcacccggcacacaccgtagcccatgctgggggctcaggaagtgctggattcaaaactgtgggctgttagagttccttggagccctaaagttcctccttaccatacgatgcagacccaggaagggccacctgcgctatggtcagaggagctggtggcagagcccgtgcagagatggtccctgtgcccccggcccagtgctctttctcctaaaccacactgccagccccaaggcagccaacctcaggtctggtgaactgctggtgttaaattatcatagagtgggtgtcaaaagatgggctactaagtacaaaaatgcccaaggtgctacatgggatctgaagattttcaaaaggaggcaagaaagagataggcagatgtttcaaggatgtggggtgggggaggtcttggtaaggaaaatggcccaggctgtgtgtcagcaataggagaggagggggcacaggtgatcagaaaagacactgggggaagcattgatggacaggaatagaaatggcaaagtggataattaagaggaaggaggatgaggagatgaacacagggtattagaaaataatagaaggcagggcttggtggctcactcttgtaatcccagcactttgggaggctgaggcaggcagatcacctaaggtcaggagttcgagaccagcccggccaacatggtgaaaccctgtctctactaataatacaaaaatagcctggcatggtggcacacgtctgtggtcccagctactcaggaggctgaggcaggagaattgcttgaacccaggaggcagaggttacagtgagccaaaatcctaccattgcactacagcctgagtgacaagagtgaaacgttgtctaaaaacaaaaaacaaaaaacaaaaaaaggaaataatagtagctgacatttactgagcacttactttgtgccaggcccatctatgagcatatataatgctcagaatagccccctaaaacagtgctcttggcattgccatttcagaggtgaggaaatagaggcacagggagttgagtggctccagttcaggcaacacaccaggtgggggtggggggctggggagagacctgggacgtgagcccagacagcttgagagctttcagagtctatgccaacagcaccaaccagtgctgggtaaacacctgcttttatcatcagaacaaagaggctgtgtcccctgccctatgaggtccatttctgagagttgtggctaatgggcaagaaggttggggctttagagatttgggataaagatatcaaacaccagaaaggtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaatctcagctcactgcaaactttgcctcctgggttcaagggattctcctgcctcagcctcccgataactgggactacaggctacaggcatgtgtcactactcctggttaatttttttttttttttttaagactgagtcttgctctgtctttcaggctgatgtacaatggctccatctcggctcactacaacttctgtcccccaggttcaagcgattctcctgcctcagcctcatgagtagctgggattacaggcatgtgccagcacacccagcaaatttttgtatttttagtagagatgaggtcttaccatgttggccaggctggtctcaaactcctgacctcaggtgatcctttggcctcagcctccctaactgctgggattacaggcatgagccactgcgtccagcctaattttatatttttggtagagatggggtttcaccatattggccaggctggtctcgaactcatgacctaaggtgatccatcctcctcagcctctcaaagtgctgggattacaagtgtgagccactgggcctggtgctttttttttttttttttttttttttttttttttttgagatagggtctcactctgtcacccaggctgaaatgcagtagtgtgattttggctcattgcagccttgacttcccaggctgaagtgatcctcccacctcagcctcctgagtagctggggctacaggcatgcaccaccatgctgcgctaatttttatattttttgtagtggtgggattttgccatatcaccctggctggtctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataacagagaatcctttttttaacggtgatgcgctgtagaaatgtgactagattttctcattggttctgccctcaagcactgaattcatctgaaactcttggtttcccctggaggccatggttcctgggcaccttgacctgggcaatcccaagtgtggcctgaaccccctttcccttggggattgttcaggtgtccctagacgccttgtggtattgtacctaatacccatgaagggagaggatgatattacttgccagtgtacacccccctgtgatattgttcataatgtccagagtgaagaaagatgatattactcccaatatcacagaaggtgtacacccccccttgatattgttcctaatacccagttggggaggggagaatatctctctcaatatacaaggggtgtttaaactctctgtgatattgttcctaatattcaggggggacaaggatgatattacccaaatattgcaggggttgtacaccccccctttgatattgttcctaatatccaggggtggagaggatattactcccaatattgcaggggtctacatcctccccccgtgacattgttcttaataaccaaaaggtgagaagctgacattactcccaataccacagggggtgtacaccccctatgagatattgttcttaatatccaggaggggagaaaatgatattactctcaatagcgcagggaatttacatcccccgtcgtaatcttgttcttaatattcaggaagggagaggatgatacgactcccagtatcgcagggggtgtgcacccccccgtgatttttttgctaatatccagggtgggagtggataatacgcaggaagtgtacaggtctctgtgatatttttcctaatatccaggggggagaggaagatattacttttaatagtgtacggggggtgtacacccctctgtgatagtgttcctaacatcttgggagggagaggatgatattactcccaatatcgcagggggtgaaaacttttttttgatatttttcctaatatccaggggtggagacgatgaaattactcccaatatcacagaaggtgtacactccttttgtcatattgttcctgatatccagggtaggagaggatgatattacttctaatatcgcaggaagtgcatacgcccttgtgatattgttcctaacatccaaaggaagagagaatagtattacttccaatatcgcagggggtgtacagccccccttgtgatattgttcctaatatccaagatggagaaatttctattattctcaatatcacaaaggatgtacaccaccaccgtaatattgtttgtaatttccagggaggggagaggataatattactcccaatatcgcaagggttgtacacccctctgtgatatttttcataatatttaggggtgaagaggatgatataaatgcaaatatcacagggggtggtcactgtcttgtgatattgttcgaaatatccaagaggggagaggatgaaattactctcaatatctcagcggggggtacacccctctgtgacattccttgtagtattcaggggaagagaggataatattactcccaatgtcgctttgggtattcattcccctgtgatattgtttgtaatatccaggaaaggagacgatgacattacttttaaaatctaaggggtgtacacacctctgtgatatggttcataatatccaggggaagagaggataa

SEQ ID NO: 14362 - DNA, 9623 bp, Human
cctttgtttgccattgttctctaaccactcacttccctctccttgtactgaggcagcagctcttgtacggcatcagcaaagagcttcgcgtagcgcctggcattctcacaaattgagtccaccaactcggggtcatcctcggctacgtcgtccaggtccacatacagagccacctgttcccgatgagccagccgaacctcaagtggggaagagacagaaacacctcagagccacattcactttgctcaccagtgttcatatgtgaaaatgcatcactgagaactcagcacaggctctgggcatccacaggggagaacgcagcgccacacagagcgatactcgcttttcagccctcaaaccctctaattgttatgtctttaataaaacaagccaagctgctgcttatggctccttaagcaccccgctccccattccctttacccaatcttagacttaccaactggttcccatacttgaactgcttcttcccgagttcatcatcctggtagaactcttgtaagaacttcttaaccttttctgtaacatgaaatgtaaaaccgtaagacacaaactttaagacaaatcttagatacccattttcgcttaaaacacgacctatgaactaattaataatatgagcatttaaataaacctaccgaagtctccccaaagtgggcataactctttttcacaagtctgtttctaaccagcgaagaataaagagcccgtggcagtgcacagggccatccaacatctccccaggggaattccggtccctactttagtttaaaattctagcgcccttccccgttggcccctcacactccggtctcaaggttctcagctttctttccacccctatgatcccccgccttctttgggtccccttagcccctgatttcaccgggacctccgccaccgcaccccgccaccgcaccccacccccgctcccgccatcgcttccgctcttagtaaacaaagaagcacatgggcccggattccagccgcttcacagctcgggattcctccgcccagggcgggagccagtccagccattggccatcacacccagagacaccgcgatcccagcccactgccgcctttcccgggcccgagcgaagctccggatcccaggcacgcccccccgggccgcagctctctccgcggccgccgcgcggaaggacactgtttacacgacactccctccagcctcctcgcgccacttccgcccggctccacttccgctcggagggcggcctcaaacggccaatcccggcgcgcagcggccccggcctgcccgcccccggggcctacgcgcgcctggggagggcgcgggaacctgggaatgcccaaaagcgcgaaggaaagcgggcacgggagcccagagcccttaagactctcctgaggtcctgggcgcgacttttccctgtgcagcccccagccgggttagcgcgcccccaagcccccaaccccacgaccctaacacctttaccaggtgggattactagcttttcttcaacatcgatggccccccgcacgcttcccaggccccgtgggccttagccaggccgcagctcgaccctgcctctggcctcgcgcaccccagaacccgccgaccccggtcccccaagaccccagctcacaccaacaggtgttccccgggaggctccccgcgcaggacgccctcccgggctcgtagacccgtacccttctctagcgcgtagtccttcagtgccatcgctgccgagggccgtgcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagactgtatcctagacccttggggctgggaaggggcggaggggccgggcgggaggggcgcccagggccagcctgtgtcgcaggatccttcactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcggggtaggtgggggtggggaaaaaaaaaaaaagagtcaatcgggcgccagcaacacaccaggcccagctccctgcgtgactccatcctcagcaactcggggtagttagtgtaattaaccccctttccacattgggaagctgggcccaggcatatgtcatgtatctcccaaaggcactgctgttgtgactagtaagaggcatcgggatccgagctcaggtctcctgggttctgatcactccacctccctttttttaacgcctctcttctccctgcctgtgtctcagcatcaccatggccgtcatttcattcacatcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaactcctggatgaagtgctggtgagaatcaacaatccccttctgtggcccctacccaattcccctgaagatacatctgctcttctactgtgggatgccgtggttaggaggccaagtctaccttttttttttttttttttttgcttttagagacagggtcttgctctgttgcccaggctggactgcagtggtgcagttatagctcactgcagcctggaactcctgggctcaagccgtcctcctgccccagcctcccctgtgcctagctaattgtttattttttgtagagactagagtctcgctgtgttgcccaggctggtcttgaactcatggcctcaagccattctcctacgtctcggccttccaaagcgctgagagtacaggagtgagtcaccatgcctggccccactccccctctttaccccttccctccactgatcactcagactgtccttcctttaccactaggactatggctatgtacagaccacatccacggagatgctgaggaatttcatccagacggaagctgtggtcagcaagcccttcagcctctttgacctcagcagcgttggcttggtcagtagagggaaagaggagggtgaggaaagaaaagaggggttggctggggttgtcagacctgatgattgattgctttggatgctttacagtttggggctgagacacaacagagcaaagtggcccccagcagtgcagccagccgccccgtcctgtccagtcgctctgaccaggtgagggaaggatccatggggtcagacgctctggttttgctctgggatccgggagtccaagatcttaggtcgggcacagcggctcacgcctgtagtcccagcactttgggaggccgaggtgggcagatcacctgatgccaggagtttcagagcagcctggccaacatggtgaaaacctgtctctactaaaaatgcaaaaaaaaaaaaaaaaaaagaaaaagatcttggcacatctcccacccccccagatgtgggtggaggtgggagatgatcccttccatcacccatgtcctcaccctagagctgtagctttgactgtcctgttctttctccctgtctgtccatttcagaacataggctattctgcttccaaccacccaaattctctctctttctcagagccaaaagaatgaagtttttttggatgtggtcgagagattgtctgtactgatagcatctaatgtaagtttgagctcccaaacctggagctgaggacagatgggacttgggaaacatggtggggtggctaagactcccagcaacggccgggcacagtggctcatgcttgtaatcccagtgctttgggaggccgaggtgggagaattacttggggccaggagtttgaaaccagcctgggcaacatagccagaccccgtctctacaaaaaatacaaataaacaaattacccagacatggtagtgtacacctgctgtcccagctacttgggaggctgagccaggaggatcacttgagcccaggaggttaaggctgcagtaagccaagatcgagtcactgcacgctagcccggatgacagagcaagaccctgtctcttaaaaaaaataaataagtaaaaaaggctgggcacagtggctcatgcctgtaatcccagcactttgagaggccgaggtgggtggatcacttaaggtcaggagtttgagaccagcctggccaacacagtgaaactccatctctactaaaaatacaaaaattagctacttatggtggcaggcatctgtaaccctagctacttgtgaggctgaggcaggagaatgtcttgaacctgggaggtggaggttgcagtgagccgagatcacgccactgccagcctgggcgacagagcgagaccgtctcaaaaaaagaaagaaaaaaagactctaaccttgacgcccctgcctctcagggatccctgctgaaggtggatgtgcagggagagattcggctcaagagcttccttcctagcggctctggtgaggcatctgcaggcaggaccaagggttggggttagggcgggttccttggtgtcttaaaccatggcattgctgagctctcctgatggtctctcctccgacagagatgcgcattggcttgacggaagagttttgtgtggggaagtcagagctgagaggtgaggagaaagtgggtctttctccccttggagtaggtcattgccagagttcatggagagaagtcagacagagcctcccctctccttgctcctctcccaaaacaggagtcaggagagaagtctctctctctctctttccaggttatgggccaggaatccgggtcgatgaagtctcgtttcacagctctgtgaatctggacgaatttgagtctcatcgaatcctccgcttgcaaccacctcagggcgaggtcagggttggggtggcctcataaattccgtccaccatggggaagggggcagtggggtcgtgagaccaaactaaccttgttgctctctggtctctcagctgactgtgatgcggtaccaactctccgatgacctcccctcaccgctccccttccggctcttcccctctgtgcagtgggaccgaggctcaggccggtgagacaatttcctgggttctagaactaccttggaacccaagccaagacctgtatgttcccaagactcactgcagagtgggggtggtggtagtggtgatggagtgcaaattggaaaaaggcttgggttgcggccggtggctcacacctgtaatcctagcactttgggaggctgaggcgggaggatcacttgagcccaggagttccagaccagcctgggcaacatagtgagaccccatctctctgaaaaaaaaaaaaggaaaaagctttggctaatggagttgggctgggcttcagcccttttccctcttgggagtacagcccacacccacacagccccacatggaggtccctggtggggaatggtgagatgccagtagaagatggcctgagtcgtggtgttttaccctctcatccaggctccaggtttatctaaagttgcgatgtgacctgctctcaaagaggtaagagtgaggctggcctggctgagttcagctctatgggacggaagacagggccagggcacctgctgcttctcccttcagatgcagctgccagcctcagaagccagttaaggtagaggctgtagaatttgggaaggtggggggcacctgtgctgaaatcctgttatgacattgaagaggaacaggacaagggactgtgccttcctggggctgactttgttcccgtctcctctgtagccaagccctcaatgtcaggctgcacctccccctgcctcgaggggtggtcaggtgagtgtgtgcacccaccacggggagattcctggggagagagtgagctcagcatgacgggtctgcctcaagaaggtgccaagcccagcaccttccctttccaaactccagcctgtctcaggagctgagcagcccagagcagaaggctgagctggcagagggagcccttcgctgggacctgcctcgggtgcaaggaggctctcaactctcaggccttttccaggtattcgctgtggacccccagcccctctcctcccacattcacttgcagcccccaccccaccctcccgaagcagctgctgcctggttcccccagcgtggtcagcttcttgccctccttcctctccctgcctctgcccctcacagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgtgcatgcatgtgtgtacgtgcacgtgtgtacgtgtctgcatgtgtgggaatccgggggctggcaggtggagcatcacggagcaggctgaggggagccggagttgggctgggagccattggcttttggagtccctggagctggagggggactgtccccagcctcctgcttccccccacaaagggcactgccgctgagtggggacggggacgatgccgggggaggaactggagaaggatgggaggtggggcctcctttgccctcccctgttgggggaagtgagaccacgatgtacttctggacactcccaggaccagagggagcagtgctggggggtgcggtggtggcggtggagaccaacttgacgatgggctgcacgctggggacggtggtggtgacgggcgaagtggtggtggaacctgagccgggggccgaggtgctgagggacaggacctggatagaaaggaaaggcaggccgcttgccctgtgccctccctgccccccagaggcctggcgaggacgcttcactcgctccctgcctgaacaagttgttcctgtagttcaccctgtagacagctatggctggagaccttgttcatgcagggcagctacagccctgcaggaccctggtgggcgcctcttccagctcttgacttggggcccagaggggactgtgctctactcctgggcctccccagggtgctctgaggtaacccaggccctccagatgctccctgtcccacagctctgcatacctgctgggtggatggggcgctggaggacgatgacattacaataaacttggttggaggaggggaaggctgtggtggggcagccgctcgtgcagacaccagtgtctggacaggaagtgcgatggagccaggaaccttcagcaagccaggggtgcgagggccaggctgtggggcctgcgagagggtcagcgtgggccggggctgcggggagaagaggaaagggggaagtggcaccatctactaagaagaggagtctgaagggagaggcctgggctcccctcgctcttcctcagtggctctcactagggctggggcatcctcactcagggcctggttgccctgagactactgactgagggcacatgtggctgtgtgcaagtgcctgtcccacacaggggttctcctctgcttcctcctattcctcctccccacccggccacggacctgcgtgatggtcagagtggtcctgttgacctgctgagcctgcagagcagcctgggcccgagccttgaccacctgggagcagaggaggggcccaagggacccgaattctgcccgataggcgtcctgattgtcaggcggtgggcgcagctttgccagaacaggagcacagtgtttctgcagaacagaaaaaaagccaggtagagggagggctggggaaaaaagccaggtagagggagggctggtgacactcttgagaagaaccttggggatggggtaaaaaaggacattccttatcatctcagtgcccctgttggaggccaaattatgctgaactattagtgtgtgtacagaacactgtgggctttctcataagaaaagatgggcacggggccaggtgcagcatcttaggcctgtatcccagcacttgggaggctgaggtgggtggatcacttgaggtcaagagcctggccaaaatggagaaacctcatctccactaaaaatacaaaaactagccaggcatggtggcacgcacctgtagtcccagctactggggaggttgaggtactagaatgcttgaacccaggtggtggaggctgcagtgagcagaggttgcatcagtgcactcccgcttgggtgacagagtgagactgtctcagaaaaaaaaaaaaaagaatggctgggtgtggtggttcatgcctgtaatcccagcactttgggaggctgaggctggcagatcacctgaggtcaggagctcaagaccagcctggccaatatggtgaaaccccgtctctactaaaaatacaaaaaattagcc

SEQ ID NO: 14363 - DNA, 12932 bp, Human
ggctgcactgctgggggccactttgctctgttgtgtctcagccccaaactgtaaagcatccaaagcaatcaatcatcaggtctgacaaccccagccaacccctcttttctttcctcaccctcctctttccctctactgaccaagccaacgctgctgaggtcaaagaggctgaagggcttgctgaccacagcttccgtctggatgaaattcctcagcatctccgtggatgtggtctgtacatagccatagtcctagtggtaaaggaaggacagtctgagtgatcagtggagggaaggggtaaagagggggagtggggccaggcatggtgactcactcctgtactctcagcgctttggaaggccgagacgtaggagaatggcttgaggccatgagttcaagaccagcctgggcaacacagcgagactctagtctctacaaaaaataaacaattagctaggcacaggggaggctggggcaggaggacggcttgagcccaggagttccaggctgcagtgagctataactgcaccactgcagtccagcctgggcaacagagcaagaccctgtctctaaaagcaaaaaaaaaaaaaaaaaaaaggtagacttggcctcctaaccacggcatcccacagtagaagagcagatgtatcttcaggggaattgggtaggggccacagaaggggattgttgattctcaccagcacttcatccaggagttcgtataccagagccacattgcgggagatggtcccctcgcccagggagccacagtaatcgcccagaagggtggccaacctgaggaaacacttggagcgtgtattttctcctcctctcagacccctcctagctaccaggtgcccagcccaaccctcctcacctggagagcagttctaggaggctgaagggagaaacgttttctgaagttgtgaccaccaaatagaggccgctgtgtctgatgtgaatgaaatgacggccatggtgatgctgagacacaggcagggagaagagaggcgttaaaaaaagggaggtggagtgatcagaacccaggagacctgagctcggatcccgatgcctcttactagtcacaacagcagtgcctttgggagatacatgacatatgcctgggcccagcttcccaatgtggaaagggggttaattacactaactaccccgagttgctgaggatggagtcacgcagggagctgggcctggtgtgttgctggcgcccgattgactctttttttttttttccccacccccacctaccccgagagggagtctcgctctgtctcccaggctggagtgcggtgtccggatctcggctcactgcaacctctgcctcttggattcaagcgattctcaagcctcagcttcccgagtagatgggattacaggcgcccgccaccacgcccagctatgttttttttttttttgtatttttagtagaggcggagtttcaccatgttggccaggctgatttcgaactcctgacctcaggtgatccgcccgcctcggtctcccaaagtgctgggattacaggcgtgagccaccgcgccgggcctcacgttagctttatttggcggaatgcaccccccaagtggaatctaccaatgaaccagtcctgggagggagctggcgcccacccggcccgacgggaccccgctcctcacccgcctcccgccactggttaccatgacaaccggggactcgtctcctggcagtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaagggtacgggtctacgagcccgggagggcgtcctgcgcggggagcctcccggggaacacctgttggtgtgagctggggtcttgggggaccggggtcggcgggttctggggtgcgcgaggccagaggcagggtcgagctgcggcctggctaaggcccacggggcctgggaagcgtgcggggggccatcgatgttgaagaaaagctagtaatcccacctggtaaaggtgttagggtcgtggggttgggggcttgggggcgcgctaacccggctgggggctgcacagggaaaagtcgcgcccaggacctcaggagagtcttaagggctctgggctcccgtgcccgctttccttcgcgcttttgggcattcccaggttcccgcgccctccccaggcgcgcgtaggccccgggggcgggcaggccggggccgctgcgcgccgggattggccgtttgaggccgccctccgagcggaagtggagccgggcggaagtggcgcgaggaggctggagggagtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcggtaggtttatttaaatgctcatattattaattagttcataggtcgtgttttaagcgaaaatgggtatctaagatttgtcttaaagtttgtgtcttacggttttacatttcatgttacagaaaaggttaagaagttcttacaagagttctaccaggatgatgaactcgggaagaagcagttcaagtatgggaaccagttggtaagtctaagattgggtaaagggaatggggagcggggtgcttaaggagccataagcagcagcttggcttgttttattaaagacataacaattagagggtttgagggctgaaaagcgagtatcgctctgtgtggcgctgcgttctcccctgtggatgcccagagcctgtgctgagttctcagtgatgcattttcacatatgaacactggtgagcaaagtgaatgtggctctgaggtgtttctgtctcttccccacttgaggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctacctattttctgggtgtttgttgttgacccagagtaagttcagagggttcttgacacttacaagatgtctgccatgaagagaaaatgtgattcaaaggaccgacccaatggggctcttttccttctgacttcctttggtgtttctgttctcacatcctagatccagtctcccactttcatgcctctgatcatgtgcccaagccaggagtgccaaaccaaccgctcaggagggcggctgtatctgcagacacggggctccagattcatcaaattccaggagatgaagatgcaagaacatgtgagtttggggtacgtggccctgggcaggtggatcgggagtccacttgaatcctgtagtcacttgtggaatggcaggaagaaagaagaacaaaagagggaagtgcaggagggaggtggaactagaatttcctgggagccttgggaaggggaaaggaggtctcagcacccctgctgtgggcttgtctgtggctgggtagcctgggagcctttgagtgggatgcctagggagggaaggttgggtccttgtccatttctcctagtcttatgtgcctttccctcccctagagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacaggtaaggaagagtttgacatgaggaatggatcatccccttttccctcacctactcattctacccacacagagaaaagagcagcaaaaccccaaacaaaacagaacccagggatttgtcaagaaattgttagggaatccagtgatgggcaagttgaagggattacatctgtatcctggcattttcctgcccaagggtttactctcagaaacctacctggaagcccatcggattgtgaagatgaacaagagtgaggatgatgagtctggggctggagagctcaccagggaggagctgaggcaaattgcaggtgaggggcaggggagagagaggaaattccgtttacatcctagctcccttttcccccagaaaataaaacaaccttaacttctctacagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggtaagaagaaacaagggagaggctcagggtggatgaagtcatttaggaggaaaaaaggatgacaagtgtccctgtaggtcacagtatgagtggacatcttgccttcgtggacacagggagggcttagaaatagtgctgggtgttaggggtaggcagaactcaaaattgctctgttgttggccaagcactgggagaagagtcattccagggctgccttcccttcctccaggcaacatcaacatctgtctgatgggggatcctggtgtggccaagtctcagctcctgtcatacattgatcgactggcgcctcgcagtaagtagttgggctttgcgggaggtgaatatagtgacagacaggaccacagtgtttattcaaaaagtaggggtgcatgttcgtcacgcctgtaatcccaatgctctgagaggctgaggcaggagaatcatttgaggcgaggattttgagaccgcttccatgtctactaaaaagttttgtttttgtttttgttttttttgagatagaggcttgctctttcgcccaggccggagtgcagtggcgctatctcggttcactgcaagctccacctcctggggtcacgccattctcctgcctcagcctcccgagtagctgggactacaggcgcccgccaccacgcctggctaattctttgtatttttaatagagacggggtttcaccgtgttagccagatggtctcgatatcctgacctcgtgatccgcccgcctcggcctcccaaagtgctgggattacaggcgtgagccaccgcacccggcctaaaaagttttttttgttgtttgggtattgttttgttttttgttttttttgagacggagtctcagtcacccagactggagtgcaatggcatggtcttggctcactgcaacctctgcctcccaggttcaagcaattctcctgcttcggcctcccgagtagctgggactacaggcgcgtgccaccacacttggccactttttgtatttttagtagagacagggtttactgtgttgggcaggctggtctcgaactcctgacctcgtgatctgcccgccttgttatcggcctccgaaagtgctgggattagaggagttagccactgcgcccggcctctactaaaaagttttaaaaattggttgggtgtggtagtgagtgcctatagtctcagttacttgggaggctgaggccggaggatggcttgagcccaggagccaaggtttcagtgagccacagttgtgttctgaagagaaccagtgggaggggaagggggacattgccagtgccccacagatcctcgggcatctcaagaaggcctggtggagggagtggaatgatcccagcgcaggcctcgcctccctggcccgtttgttgtcttttgcttgttctctttcttgttctttctctctcatggttccttatttcttctcttccaggccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggtgaatgaagctcaacacccaaagagaggtcccctgtaatgatctgtgtagggaggaggggaggtgaatcagaaaacaaattccacgctcctggaaaccccagagcctcccctttgcagcaggggctggtccatggttctcagggaaatggtgggttggggctgaaatgctgatgaggatttcccgggaaagcttgtccctcctacactgtgaggaagtggcagagccaaaggagggacacctaagaggacatgggtgcgtagccctaaaaagggtgttccttctaaccttccctctgtccaggttggcccagcacatcacctatgtgcaccagcacagccggcagcccccctcccagtttgaacctctggacatgaagctcatgaggtaggagagctgggtgcgggtgggcaaacgttggcgtgggccgtgcgagcctcctgaaaaagtgcttattagtcttagggtgtgtgtttttcacaccaccacttcccgctacagacatgtccagagcctcagatcagcttttaagtggaaaattccacacttcatatcatagggacacaggaaattttgtttcctacactatttattttttttgagacgaagtcttgctctgtcacccaggctggagtgtagtgatctcagctctctgcaacctctgcctcccagattcaagcgattctcctgcctcagcctcctgagtagctgggattacaggcgcacgccaccacgcctggttaattttttgtattttagtagagagcagtttcaccatgttggccaggatgcccacctctgcttcccaaagtgctgggattacaggcatgaaccactgctcctggcccacaaaaatatttttaataaaattaccttcaggttatgtgtatcagttgtatatgaaatacaggtgaatttcatgtttagactggagtcccatccccaagctatctcatgcatatgcaaatactccaaaatttaaagtttaaaacacctgctcccaggcattctggatgataatctctatcgctattttcccatgagcctccagtgttctttccggtttttactcccttttaaatattctgtaaacagttctctttaaataaaatatatgttttgccatgtcatgcgctcagaggaggggtctggatcctctcttaatgacagacggatttgtcttacaaaggccattttcccgaaaaaaataggaaataacttggaggatactggtgggggctatacgtttggtgaaatccatcagtgatattcaagccaagcaaataatcacccactaatttgtgttttccacttaaaattcttggaggggaccatgttaaatggggagccctggtacagaaaacaacatgggctcatattcactcccttccccatctccctcttctgcttccccatgaaccttcccccacaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggtaagtgcccaaattgctggagggccatctgttttgacccttaaaggggtagctccttaccgtgctctcattgccgcctccccacctcccgctccagccctgccggggctaaagtgctgacagtgcagatagtggtcctctccgtgctaccgcactgtgggtacttgctgctccagcagggcacgcacagcgtccgtggagggaaaggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctgagctagcacttcccgagcccccgggacacgttctctctgccaattgtcttcttggctgagctccccaagctccatctgtcatgctggggagcccagtggcgttcaaaagggtctggtctccctcacaggacagctgaactccgggactggccagtgttgagaggcggagacttgggcaattgctggacgctgccctgggcattgcacttgtctcggtctgacagtgccggcccaacactgcggatgctggggggaggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggtgagtggtttagtgaaggacaaagctgtgtcactttgtcttctgtggccatgtgtctgaggttggcctcaattctaacactggccaccattgttctctgttgatgtcgagcattcctgtttgtatcctgaccttacacacccactcatttccttcaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttctagcctgggcctgacttccattaaaacagggttttgtgcgttttttagattcctgttcgtttttatgctatttcatccactcagtaaattacctgagtaaagtgcatctccctgccaggcccccagtatagacactggggatgcggcaaggactaagcggtccctgctgtttggagatacttaagatggggctccactttttgagccccccgactcccttatttggtcttatactgcctgtgtgcaagtcaggctctggggatatggcgccagtatgaaatgcagggtctcttggtttttccccttttctagcagacaggtcattacttagttcccaactcccactctaaagctctggttagcgggtgatgaaaatcagcacaagtgatcacatacagcaatcccaacctttagaccacttcctagctgcctctccaaaatatgtagtaaacggtcattgagaaactctccctcctggtaattcacagtgcccacaggatcaaggcttggacttctttctaataaaaatctgcttactatcccttcttttttgcgtatgtgaaaaacaagttaatttagctcaggaaagtagtcaattatcatgtttataaggttgggtgggctaggtaagatgatgtagagggtgacattaaagtgtagaacagagaccacttaggtggaagcaggcagccttggactttgctaaagaccagtccatgtgactgacatggggtcacttcaaatggtagtgcctccctcactgaagagcatcagaagggcttctgagcaaggccagaatgagcctcgatgaacatccaagttgaccaaccagtgtggtgcctaacagaggacagagccaccagcaggggtgctcaggggctgctccccttttattaatgacagcggtttctctcaaggaagtgtagtgccctcccctttgggatagttgcctgacccctgtccatcagcccttcaagtaccctcatcagaaaaagagcccgcgcattctcctgccgatgccttgtcggtcgtagaggacattgaacttgttcacaaactggttcatggtgttgcacgttttggtgatggtgccgaggtaggccatgagccccacgtcgttgcattgctgggagggaacagaaaggaccagttcctcgggatccctcgtggcatgcccggggaacaacagtccccagtcctgcacgtgaaagtgacagcataagccccgcctccccatccgggttttacactcacatcataaaaatctgtcttgaacttgtctgtgctgagcaccgggagacagtgacacagagcataggcctcccgcaggatctcatgattaaaggggacctctcctaaaggcacaaaaagagactacattagtttggatgctgtcacttccccaggagggagaggaagaatgccagggaagcccctgtcctacccgcttcagaggccttgacgtactccaagatgagcttgacgcggctgtgcagcatcttgatggcgctgtgctgtgctatcaggtgttcagccactgcaaggggatgaggacaggaggaggttgagacgggatgtggccacaccttccaaccccacttccaaggaatcccctccattaccagtggagttctctccactgcctgttgctgtcattcgggctacgtggtctacaccaatgcgttccgcttcctctgtggccagagtgtaggtcagctcagcaaacagcattgtggcctacagggcaaggtaacccacaaagggagaatcaaaagcaggaaagaggccaagagcaggatctgagggttgaagggtagggtattacctctccattgattatatcaatgacagactcaaaaacgctgacaggaagctgtgaaggagacggagaaacctgaacactatatgccaacatttgggctagctgcttttacacatttcctctcatcttcccaagaaaccaatgaagtagggattacctcctttcacagtttggagattaaatgactaagccagagtcacagctggtaagtggcatctggcattcc

SEQ ID NO: 14364 - DNA, 24207 bp, Human
  misc_feature (1)...(24207): n = A,T,C or G
agttcaagaccagcctgggcaacacagtgagaccatttctgaaaaaaaatgaaaaaaaaaaattagctgatagccaggcatggtggttcatacctgtaacctcagcactttgggaggctgagatgggcagatcacttgaggccaggagtttgagaccagtgtggccaacatggtaagaccctttctctactaaaaatataaaaattagctggacatggtagtgtgagcctgtaatcccagctgctgggaaggctgaggcacaagaaccaattgaacccaggaggcagaggttgcagtgcagtctgcagtacaagattgtgctattgcattgcagcctgtggggacagagtgaaaccgtgtttcaaaaaaaaaaaaaaattagtggggcatagtggcacttgcctgtcatcccagctacttgggaggctgaggcaggtggatggcttaagctggaggctgcagtgagctatgactgcacaactgcactctagcctgtgtgacaaaaaaatatgaacaaatacataagtcaggtgactaaggggtcatctttatgccctgtaccttctctcagcaacctccatcctataagaaaggggcaattggccaaagtatgcctctgctgtagttgtagattaccatgtttgcacgattatcattgtcaatgcttcacatttacactagggcactatgattttcaatgcagtttccatttttattttggaggcccctcccacgaaccttctcccattttactgaggcccagggagaatgcacagggagctgagcccctcctttgatcttagtttggtggcagagacaggcagtgatactgacgatgtgatggcagtgtcaggtgcactctgtcttcactagaaaactggcctcctggaagggctggaagctcccacccttgactgctctgactctgtctccagcagctcttcgctgttagggcttccctgacaagagtgcagtccctctcgaggctgattagtgcagggcgggctcctcgtctccgaccaccggctcctgctggctgttccctccaccctccgtctcgggctgcgaggcttcccttaacactcgaaaggggggcccgtgaccaggtacgaccacgtcggcaacgaccaggaccctcttccggctccgctcctgggctgcggggtcttcactcagtgcctgccacgaatcctcgtccccatctcgctcaaacacatctcccgccaccaccacggtgcccagagccgtgccggccaccaccacgctcacgtcgcgctggcccccgtggcccggcgtggcccacacctcgagccccgggcccaggcgcaggggctgcccctcacccagcccgtggggcaggtagcggcctccgggaaggcagaagtcgtgcgagaccagcagagccgcgcctgggaacagccccaagttcccgatgtgatccgagtgcccgtgggtccccaccactagcgtcacgtctcccggggccacgccctgccccgccagcgcccccagcagcgcctcccgagcccaggggcccccggtgtccaccaggatggggccacgggccgcctcctccagggcggcctctgcgccgccactcccgcgcggggactctcggtggctggaggccgggccccgggtctggggtaggaccagggtcacggagccgtcggcgcgcacggcatcgcccacaccctctggctccgcgtagccctgcagcagaaccaccacagagtaggggtcgccgggcaccagcagaggggatgccccgcacagcggctcggtccgcatgaggctgctcctggcagggagggacgggctggggagaaaggaaatggagcagtgggcgaccgtcctgtccctccgcgatcccccacccgcgctcggccccgccactgcccctaagcctcggttctctgccacccgcctcccattaagttggtatcaccctcaacccctgcccaaaatggtatcgcccagactcccttcacacttgggcccgcccctccctcggcgtcctcggcccccgccccattccgttcgcggtacgtacgtccttgcccgtcaccctccaaaggctatcctttatgtttccctccatcgaatcctagccgcgctctaccttgggcctctgctaggtcttgcctcactcgaagaaagcgcagaaatcgaaaacgcgggtgagagtttgtcctctgcggttcccgtgtacccagatatggcggccgaagcggcgccgcggaggtagctgtagttccggcgccttcaccgtgtgcccgaggaggctgcctggctgggctccagcctcctggcggttctccgctccgcaaccccagcaacttctttgcactgcagaattttgaagcgccattagctttgaggagggttcatgctcagttgcccaggcaggagtgcagtggcgcgatcatacctcactgcagcctcaacctcctgggctcatgtgatcctcccgcctcagcgtcccgagtatctgggaccacagatgcgcaccaccaagcccagctaaggtttctattttttctttctctttttttttggagacacggtctagttctgttgccaggactggtctggaactcctgggctccagcgatcctccagtcttggtctcctgaagtgctaggattacaggtgtgagccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacaggcgtgcacgcccctctaaattttttttggttttttttgagacggagtcttgttctgtcgcccaggctagagtgcagtggcgtgatctcagctcactgcaacctccgcctcctgggttcaagcgattctcctgtctcagcctcccgagtaactgggattacaggcgcccaccaccatgcgtggcttttttttttgagacggagtctcgctctatcacccaggctggagtgcagtggcacgatcttggctcactgccagctccgcctcccgggttcccgccattcttctgcctcagcctcccgagtagctgggactgcaggcgcctgccaccacacccggctaattttttgtatttttagtagagacgggctttcaccgtattagccaggatggtctcgatctcctaatcttgttatccacccgccttggcctcccaaagtgctgggattacaggcgtgagtcaccgcgcccagccgcccggctaatttttgtatttttggtagagacgaggtttctccatgttggccaggctgctctcgaactcctacactcaggtgatccgcctgcctcggcctcccaaagtgctaggattacaggtgtgagtcactgcgcccagcctccaggctggtcttgaccttttggactcaagtgatcctcccatctccacctctgcagtaactgggactacaggcgctgcaccaccagccctgcagtcttctttgtgtgtgtgtgtgtgtgtagaattggggtttcactatgttgctcaggctggagcttgagcttaacaagacagcggccattctgggtgctgcctcatcgaccagctagctatgtgtgcccggctgttgtttgaaactttgggcccagctagtttttagaaaaaaagaaaaaagtttaatagcgatatagaaaattgagcacctataaaactatatggtgggctctgggttacattgagcttaagtagaccaagtatctatcccacctaaattatcagcaactccaggccatgacccagtgtcccattctccttcacggtttgctggtgtgtagcctcctggatacaggcaatgtatatagatcgcagagaatgtccgttctggcctcttccttggaagggtctaaaaacagaccttaaggagctaagtgacttccccaaagcccacagctccagtgccactgctgacttttgggtgggggtgggatcagttaaagaggaaagctttcagtactgtcagcacatacacctgccaattaaggggctggatagagttcatctctaggagcaggacctccacccccaccctccaccccagaagccatgtcatgctgtttcaccaggatcttgcctgaggttagatgggagagaacagctacaagcttgggtggagtcactcataaacacaccctgaaagctgtggagcagggagagtgcaggctttagagggctctccatgatcccttcccctcctgggggctcaaaggcaagggtcaaagatcttctcggtcaagtttggggtggcttcctgtcttggtcatcttgtctcccccttcctcttcctcctcttcctcctcctcctcctgctcttcctccccttctgttttctcttccccatctgtgatctcctttccagtccaagtttcctgtagacatgctagatcggatgacagaaaacaatttagatattagtcctggaggcaggggaggctatggcttggcaggagaggagttcaacccttacgcttaccagtttcagcagctgggagcacatgaccttcacagagaaaattttgtaggggctgctcctgatggtggaagtaccagtctcccacaatgtcttcaaactcctccaacatggtctcacactggtcaagtagaagggccagaagagtatctgctctggagggatttgggatcccgcctgtcttctctccctgctcaacctgactgattttggagaggcaggtagccaggaagctaagtttggcctactagatgtgcaatcctcattcattcaacaaacatttaccagcacctattctgccaagtagattattaaactcttgagtctcagctccttgcctgtaaaatatgtatggtaattgcacctaccacatcaggctgttaagggtaaaatgaggctacagatgcaaagtatctggtccagagtctgggacacagtaggtgctcaataagtgatggtggatatcattagcaaccattgttacttttttttttttttgagatggagtctcgctctgtcacccaggctggactgcagtggtgggatctcagctcactgcaacctccgcctcccgggttcaagtgattctcctgcctcagcttcctgagtagctgggactacagatgcatgccaccacaccaccacgcccggctaattcttgtatttttagtagagacagggtttcactatgatggcccggctggtcttgaacccctgatgtcgtgatccgcctgtctcgccctcccaaagtgctgggattacatacgtgagccatcgcacctggcccattattactttttaaaaattttccttaaggcagggcccaatggctcatgcctgtaatcccagcactttgggaggccaaggcgggtggatcacctgaggtcaggagttcgaccagcctggccaacatgatgaaaccccgtctctactaaaattacaaaaaattagctgggcgtggtggcaggggcctgtaatcccagctactcgggaggctgaagcaggagaatggcttgaacccgggaggcggaggtcgcggtgagccgagatggtgccggtgcactccagcctgggcaataagagtgaaactccgtcttgaaaaaaaaaattctttaaaattattattatttgtagagaagggggtctcttatgttgcacaagctggtctctaactctggtctcaaacagtccttctccctcagactcactaagtgctagcattacagttgtgagccactccacccggctcattatgatttctttttttttgtttttgtttttgtttttttttttaagatggagtcttgctctgtcgccctggctggagtgcaatggtgcgatcttggctcatggcaacctccacctcctggattcaagcaattctcttgcctcagcctcccaagtagctgggatcacaggcgtgcaccaccacgcccagctaacttttgtgtttttattaaagacggggttttgccttgttggccaggctggtctcgaacttatgacctcaggtgatccacctgcctcagcctcccaaattgctgggattacaggtgtgagccaccgcaccccaccgctcctggacccactttaatcaatggcacagtcctcactctgcccccttccccatgcttaggggtagacatcccctatagtcaaaccctagaacctagctcccctctcaggttcccttctcacctccctggatggtgcagtgtcttatcctacctgcttcttgaggtatgtgacctccacgctgggctcatcccaaagctccagagggatccccagatccaccttcacccccttctgcactaggcctttcagtgttgccatggtctgactctgaccctgagagattaagaatttggcatcagcccagctcaccaccccacccctcccttcccctttctgccatttcagttttgtcaactactggagattcaagggtgagttccatgatggtgagatgatgggcagataacctctggagggcctcaggggatacagatctttgtatctgagaagtggggtcctgccctggggaagggtctgaccttggcatatctcagtgagcccttgcgctcagcgtgaacactatagtccaggatccgctcacataaattctctaaggcctcttccagccttgtctctctgtggaaagagaggaaacaaagattccctggatgctgtaggaactcccagggctccgttgggggttggaaaggggaggagcacgaaggactcacgaaacgctgtaaggcacgtgtctcttcctcttgcctgtatccagcacctgccccagctccagcacctctcgagatcgaccggtgcgactcagttccgcctgtagctctgtgctcagcagcttacacactggtggggaggagaaacgtccggggggaggtaaaagacaaacacaccagccattcattctgcagatgacctgaggcagcagagcatacaagtgcagactatggagccagactggctgggttggaatcctggctcagccatttagcagctgtgtggcaatcttcctgcttgctgtgcctcggtttcttcatcttttttttttttttttttcagacggactctcgctctgtcgcccaggctgtagtgcagtggcgcagtctcggctcactgccagctccgcctcctgggttcacgccattctcctgcctcagtctcccgagtagctgggactacaggcacccaccaccacgcccggctaattttttgtattttttagtagggacggggtttcaccgtgttagccaggatggtctcgatcagctgaccttgtgatccgcccgccttggcctcccaaagtactgggattacaggcgtgagccaccgcacccggcctaaaaagttttttttgttgtttgggtattgttttgttttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaaactctagctcaaaaaaaaaaaaaaaaaaaaagagccctgtctagatggtggacggagacggggtctcactctgttgccaggctggagtgcagtggcacaacctctactcactgcaacctccacctcctgggttcaagcaattctcctgcctcagcctcccgagtatctgggactacaggtgcacatcaccacgcccagctaatttttgtatttttagtagagatggggtttaaccatgttggccaggatggtctcgatctcttgacctcgtgatctgcccacctcggcctcccaaagtgttgggattacaggcgtgagccactgcgccatgcccaaaagatgttaaatgctatggaaaagaaaaagtgggctgcccccactctgagggcagagtgcagagttaaatagggtggtcagggtaggcagccaattagatatttgggaagaacattccaggcagagggaatgcagcaaaggctattaagcaagtacatacctggcaagtttaaggagcagccagaaggaatgtatgtgtctggatcaaagtggaagaaggaagggcgttcagagatataatggggagaaggtaattttgaagggctttgtaggacattataaggatttcgtctgttttttttgttgttgttgttgttgtttttgagaagaagtcttgctttgttgcccaggctggagtgcaatgacacagatctttgctcactgcaacctccgcctcccgggttcgagtgattcttctgcctcagcctcccgagtagctgtgattacaggtgcccgccaccatgcccatctaatttttttatttttagtagagatagggtttcaccatgttggccaggctggtcttgaactcctgccctcaagtgatccgcccaccttcgtctcccaaagtgctaggattacaggcgtgagccactgtgcctggcctgagatggggttttgctatgttgcccagggtggtcaggaattcctaagcccaagcagtcttcccacctcaccctcccaaagtgcacagattacaggcatgagctgagccactgcacctgcccattataaggatttcaggttttactttatggcaagtggagagccattatgagggtttgagcaaagaaatgacaatctgctttacagtttgacagaagcattttggctgcaacgttaggaatagatgtagagaaaggcaagggtagactccggttgacattgttaggaggtttttggagttacccagtggatagatgatggtgacctgggccaagcagtgggagcagaggagtcaggttggactacctggtggattgattgatttttgagacagagtctcgctctgtcgccaggctggagtccagtggcacgatcttggctcactgcaacctccacttcccaggttcaagtgattctcttgcctcagcctcccgagtagctgggactacaggtgcgtgccaccacgccaagctagtttttgtatttttagtagagatgggatttcaccatgttggccaggatggtctccatctcttgacctggtgatccgtccgcctcggcctcccaaagtgctgggattacaggtgtgagccaacgcgcccgaccggatttatttttttaccttttttttttttttgagacagagtccatctgtcactgaggctggagtgcaatggcgcaatctcaactcactgcaaactctactgccgaggctcaagtgattctcctgcctcagcctcccaagtagctgggattacaggcacgcgccaccatgcccagctaatttttgtatttttagtagagaaagggttttaccatgttgctcaggctggtctcgaactcctgacctgaagtgatccacccaccttggcctcccaaattgctggaattacagacgtgagccaccgcacctggcctacctggtggatttgatgtgaaggctcagataaagaacaagtgtctggatggatggcattgctatgaagataaggaaagctgagcctgggccagacacttcggctcacgcctttaattccaacactttgagaggccaacgctggaggattgcttgagcccaaaacttcaaagtggtgggattgaagccctgaggtgtaacagaaaaagataaaaatctgggctgggcctggtggctcaggcctgtaattccaacactttgggaggccgaagcaggaggactgcgtgagcccagcagttcaagaccagcctggacaacatagtgagactctgtctctgcccctgcccctgcaaaaaattggctgtgtgtagtggtacacacctatagtcccagctacttgggaggctgaggtgtgaggattgcttgagcctaggagctcctgggctctatcagttttcccacctctgcctcctgagtagctagaacaacagccctgtgcctgcatacccagctaatttttgtattttttgtacagatggggtctcactgtgttgtccaggctggtcgtgaactgctgggctcaagcgatcctcctaccttgggctcccagagtgttggaattacaggcatgagccactaggcccagtccagattttttttttttttttcctgagacggagtcaccctggctggagtgcagtggcgtgatctcggctcactgcaacctctgccctctggtttcaagtgattctcgtgccttagtctccctagtagctgggattacaggtgtgcactaccacgccctgctaatttttgtatttttagtagagatggggtttctccatgttggccaggctggtctcgaattcctgacctcaagtgatccgcccgcctcgtcctcccaaagtgctggtgggattacaggcgtgagccactgaacctggccccagcccagatttgtatctttctctgttacacctcagggctgactcacgtggggatggacataagacactcggagttcctcccctgtctccactgtcctccctttgttggccctctccctgtgtctcacgtttctttttcttctgcctgccccgttcctctgccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggtgacccggcccttctgtccagctctacattgggtccatgtcacccagggccccgtccttaggattttgggctgatgtctgttctgtcaccgaccccaggatgccttgaagttcatgcacatggggaagcggcagaagctcaccaccagtgacattgactacgccttgaagctaaagaatgtcgaggtgatttggggagacaggcgggggggggtgagacgccatccttcagccaggtctcctccggctcccttcttacccatgcccctctctcctgccacagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaaggttgggggaggggagagcagggtggcagggaggagggaaaggaggacagatgtgtgtaggtgtgaggagcctcacaatagaagaaaagctcagtgtgagatccctggtgagttgcaaggggagcaggagtggaaacacgcttccatagcatggggcaactccccaatgtccatgcgtggcaattcaccttgacacctgccttccttgcagctcattggctgagcatcgagggctgccagccagctatccccgagaacccgcccccaggtaacctccatgccccaccctctgggtctctgggtccctttccccttccttccaccttttttttttgagacagagtctcactctgttgcctgtgctggagtgcaggagtgctggagtgcagtggctcaatcttggctcactgcaaacctgtgcctcctgggttcacgcgattcttgtgtctcagcctcctgagtagctgggactacaagcacacaccaccacgcccggctaattttttgtaattttagtagacacgaggtttcaccatgttggccaggctggtctcgaacttctgacctgaggtgatccacccgccttggcctcccaaagtgctgggattacaggcatgagccaccgcatccggcctcctcccaccttttacttttctactatgctcatcacccctcccgctgtgcctgctttcccaccagctcccaaagagcaacagaaggctgaagccacagaacccctgaagtcagccaagccaggccaggaggaagacggacccctgaagggcaaaggtcaaggggccaccacagccgacggcaaaggtcagtcctcctaggctaggcctctctggactcttgcccaaagccacatggccgtttgttttgtttcctttttttttgtttttgagacagagtctcactctgtcacccaggctggagtgtagtggtacgatctcagctcactgcaacctccacctccagggttcaagcgattctcctgcctcagcctcctgagtagctgggcttacaggtgcccaccaccacgcccggctaatttttgtaattttttttagtagagacagggttttgctatgttggccaggctggtttcaaactcagcctcatgtgatccgcccgccttggcctcccaaagtgctgggattacaggtgtgagccaccatgccaggcctccatgtggccattggtgaagtggctgaggtcagggccagagccccagaaaggatgggggagcctaagaagaagccaggtctcctgggtctcaggggaagtggagggttaaggttcttctgttactgaggtttcttctggagctttctttgtcagacccacctttccaatcacacagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggtgagggccccaccagcttgccctggccctgagacgcctcctcctgggggccctatgaattgctccccacatcccacccccacctgactggcttccctcctcccacaggaagccctgcaaagcattgccacggaccctggactgtatcagatgctgccacggttcagtacctttatctcggagggggtgagagcatgaggttccacagtgcagggacggcagtggaagctcctgtgagggtctccctgccccatgcccagcacttctccctcccacaggtccgtgtgaacgtggttcagaacaacctggccctactcatctacctgatgcgtatggtgaaagcgctgatggacaaccccacgctctatctagaaaaatacgtgagtgatcctgcccatcctcccttccagggactagggaccctgctgccaccaacaggaagtcagtggtcagcagtggctcacacctgaaatcccagcaactttgggaggccgaagtgggaggattgcttgagctcaggagtttgaggacagcctgaggacagtagtgagactgctatctctacaaaaaaaattaaccaaaacaaaattagccaggcatggtggtgcacacctgtggccccagctacctgggaggctgagatgggagaattgcttgagcccgggagattgatgctgcagttagccatgattgtgtccctgcacaccagcctgggtgacagagcaagactttatctcaagcagacaaacaaaaccagaatcagctgtcccgccctttctcccttaggtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaaggtgagccaggaaaacttgagcgtcatttgcttcatcactggccacctctggttgggggaagtcacactggaaacaagggggcagagggaagagggactggaacttgtgggggtctaagggtcttgaggcttgtctgtaataccttttttttttttttttgagatggagtctcgctcttgcccaggctggagtgcagtggtgcaatctctgctgaccgcaccctctgcctcctgggttcaagcgattcttctccctcagactcttgagtacttgggattacaggcacctgccaccacaactggctaatttttttgtttttgtttttttgagatggagtttcgctcttcttgcccaggctggagtgcaatggtgcaatcttggcttaccacaacctccgcctcctgggttccaatgattctcctgcctcagcctcccgagtagctgggattacaggcatgtgccgccacacccagctaattttgtgtttttagtagagacggggtttctccatgttggtcaggctgctctagaactcccgacctcaggtgatctgcctgccttggcctcccaaagtgctgggattacgggtatgagccactgcacctggccacaactggctaatttttgtatttttagtagagacagagtttcaccatgttgactagggtggtctggaactcctgacctcaggtgatctgcctgcctcggcctcccaaagtgctgggattacaggtgtgagccaccacgtctggcctcattgtaatgtcttaatgatttacaaggaaagtgtctatgaaagacttaggtccctatcaatcatcctttcagaccccttcatcttagtttatttccttccccttacagagctgggtggacgagaagacgccctggacgactcgttatggctccatcgcaggcttggctgagctgggacacgatgttaggcctctgggaggaagaaatgggggaggggacacagtcatgaggttatagagggcactgtacccccatctgggagaccctggtgaccctccggcttttgcttgtccttttcccttctaacaggttatcaagactctgattctgccccggctgcagcaggaaggggagcggatccgcagtgtgctggacggccctgtgctgagcaacattgaccggattggagcagaccatgtgcagagcctcctgctggtgactgaagcccctgtccccacacctgcccactgagacacaggcagtgtttagcaagcatatggcatattttattcacttactcccatctttgcctcatgttttcagaggacattgcagagtctgatactattttacagatggaaagactgagattagactgagtaagaaataagggggctgggcatgatggcttctgcctgtaatcccagcactctgggagcctaggagtatgaggccagcctggacaacgtagcgagatcccacctgcaaaaaaaaaaaccaaaaagccgggagtggtgacatgtgtctgtggtcccagctactagggaggccgaggtgggaggattgcttgaacccaggagttcaaggctacagagagctatgatcgtgccactgcactccagcctgggttacagagggagaccaccgccccccaaaaaagaagggtttaacacgctcagcctgtggcatttggaccatccttccccaatgctcctgttactctgtggtcttctctgtacaaggcaaatgcgctcttgattaaccatcctgccacagtatttagcaagttcattcacacattagtgcccatgttttctttttcttttctttttttttttttgagatggagtctcactctgtaacccaggctggagtgcagtggtgcgatctcaggctcactgcaacctctgcctctcaggttcaagcaattctcatgcctcagcctcccaagtagctgggaccacaggcacgcgccaccatgcctggctaattttttgtatttttagtagagacggggtttcaccatattggccaggctggtcttgagctcctgacctcaggtgatctgccagcctcagcctcccaaagtgctgggattacaggcatgaaccaccacacccagccattcttttttttttttttctgagacagtctcactctgtcacccaagcgggagtgcactgatgcaacctctgctcactgcagcctccaccacctgggttcaagcattctagtacctcaacctccccagtagctgggactacaggtgcgtgccaccatgcctggctagtttttgtatttttagtggagatgaggtttctccattttggccaggctcttgacctcaagtgatccacccacctcagcctcccaagtgctgggatacaggcctaagatgctgcacctggccccgtgcccatcttttcttatgagaaagcccacagtgttctgtacacacactaatagttcagcataatttggcctccaacaggggcactgagatgataaggaatgtccttttttaccccatccccaaggttcttctcaagagtgtcaccagccctccctctacctggcttttttccccagccctccctctacctggctttttttctgttctgcagaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcaggtccgtggccgggtggggaggaggaataggaggaagcagaggagaacccctgtgtgggacaggcacttgcacacagccacatgtgccctcagtcagtagtctcagggcaaccaggccctgagtgaggatgccccagccctagtgagagccactgaggaagagcgaggggagcccaggcctctcccttcagactcctcttcttagtagatggtgccacttccccctttcctcttctccccgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtatgcagagctgtgggacagggagcatctggagggcctgggttacctcagagcaccctggggaggcccaggagtagagcacagtcccctctgggccccaagtcaagagctggaagaggcgcccaccagggtcctgcagggctgtagctgccctgcatgaacaaggtctccagccatagctgtctacagggtgaactacaggaacaacttgttcaggcagggagcgagtgaagcgtcctcgccaggcctctggggggcagggagggcacagggcaagcggcctgcctttcctttctatccaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacacgtacacacgtgcacgtacacacatgcatgcacgctaagcggaaggaagttgtagattgcttccttcatgtcactttctttttagatattgtacagccagtttctcagaataaaagtttggtttgtaagttctgatccactgcagtccttcctgcatcagataccacagaaaggctgggcccattgccccctcctggtcttgggactgaggactcttcctgcccagattcagagtccgaaggccaggaggctggaaaagaaacgactgtcctcccgtgggacaaactgccaccttggccgtcgtgtcctcgtttggggagcctcagatccgaatgacataggcgtcgctgtggcttaggtgtcgcacccacttgtgggggttggcattgccgcatggcctgaaggccagcctgaggaatcggacctggaggccagagcacgtgtgccggggaagctcgaaggagagactggcagggcccagccccagaggagaggccgaggtggagagcccatggctgggaggtcctgggggccctgggacgtccatctgtgaggggcagaggcagggagaggaaggagggcaagaagctgaccacgctgggggaaccaggcagcagctgcttcgggagggtggggtgggggctgcaagtgaatgtgggaggagaggggctgggggtccacagcgaatacctggaaaaggcctgagagttgagagcctccttgcacccgaggcaggtcccagcgaagggctccctctgccagctcagccttctgctctgggctgctcagctcctgagacaggctggagtttggaaagggaaggtgctgggcttggcaccttcttgaggcagacccgtcatgctgagctcactctctccccaggaatctccccgtggtgggtgcacacactcacctgaccacccctcgaggcagggggaggtgcagcctgacattgagggcttggctacagaggagacgggaacaaagtcagccccaggaaggcacagtcccttgtcctgttcctcttcaatgtcataacaggatttcagcacaggtgccccccaccttcccaaattctacagcctctaccttaactggcttctgaggctggcagctgcatctgaagggagaagcagcaggtgccctggccctgtcttccgtcccatagagctgaactcagccaggccagcctcactcttacctctttgagagcaggtcacatcgcaactttagataaacctggagcctggatgagagggtaaaacaccacgactcaggccatcttctactggcatctcaccattccccaccagggacctccatgtggggctgtgtgggtgtgggctgtactcccaagagggaaaagggctgaagcccagcccaactccattagccaaagctttttccttttttttttttcagagagatggggtctcactatgttgcccaggctggtctggaactcctgggctcaagtgatcctcccgcctcagcctcccaaagtgctaggattacaggtgtgagccaccggccgcaacccaagcctttttccaatttgcactccatcaccactaccaccacccccactctgcagtgagtcttgggaacatacaggtcttggcttgggttccaaggtagttctagaacccaggaaattgtctcaccggcctgagcctcggtcccactgcacagaggggaagagccggaaggggagcggtgaggggaggtcatcggagagttggtaccgcatcacagtcagctgagagaccagagagcaacaaggttagtttggtctcacgaccccactgcccccttccccatggtggacggaatttatgaggccaccccaaccctgacctcgccctgaggtggttgcaagcggaggattcgatgagactcaaattcgtccagattcacagagctgtgaaacgagacttcatcgacccggattcctggcccataacctggaaagagagagagagagacttctctcctgactcctgttttgggagaggagcaaggagaggggaggctctgtctgacttctctccatgaactctggcaatgacctactccaaggggagaaagacccactttctcctcacctctcagctctgacttccc

SEQ ID NO: 14365 - DNA, 4763 bp, Human
ctctataaataaaaagcacactggctgggcgcagtggctcatatctataatcccaatgctttgggaggctgaggcgggcagatcacctgaggtcaggagtttgagaccagcctggccaacattgtgaaaccctgtctctactaaagatacaaaaattatctgggtgtgatggaaggcgcctatagtcccagctactcaggaggctgaggcaggagaatcatttgaacctaggaggtggaggttgcagtgagccaagatggcactactgcactccagcctgggcaacagagcgacactccatctcaaaaaaataaataaataaataaaataaaaagcacacactatcacaaagaagatggtggcaaaaataataataaaaatagtaagtaaataaatagcacaaaagtatttacagtaaaaattaggtctccttccagcccccacctgccaatcactctcaggaggcacccactgtcttcagctacaaagctttcagagagattttattaatataagcaaatacatactttttaaaaaagtataaataaggcctggtgcagtggctcacgtgtgtaattccagcactttgggaggatgaggtggaaggatctcttcaggccaggagttagagaccagcctgggcaacataacaagacccccatctctaaaaaaacaatcaaaaaaactaactgggcatggtggcatggttctatagtcccagctactcaggaagctgagagtgagggatttcttgattccaggacttcgaggctgtcacccactccagcttgggtgacagagcaagactctgtctcaaaaaaaaaaaaaagtataaatactagcatatcatatattgccctggacttttctttttgatttaacatatcttggagattcttccatagctgtggataaggagttgcctcattctttttcagggtaagtttagtataaagggtgatatagtggggaaattatatttaatttatttttgccaactcagtagcagagctgtgacaagattaatccttagatttttggaggttcatatcaaatcattcaaagctttgacatttttctattctttgtggctctattttcatcactaaaattccccatcctatgcccctgcagcccccatctgacatttgtcacttctctagcttagtcatctgatctaattttgatgagtcagatgtaaataaacccagataatgtgtcttttagcccaaaagactaaaagataaaataaaaggaaatgcataggacacagggcagtttgtcgaatggctgagatttgaatatgtgtgtattaattctttctgaattacagctagattctgccctccccagctttgtatctggagacgagggaaaatgtgaccccagttcatattatgcgtgaacatctctgactgttctaagaagtcctattcccttagattactgaagttcacagggagaaagcacccacccagatatttttggtttttgtttgtttgtttgtttgtttgttgagatggagtctcactctattgcccaggctagagtgcaacggtgtggtcttggctcgctgaaacctttgcctcctggttcaagcgattctcctacctcaacctccaaagtagctaagatttcaggcataagccaccatgcccagctaatttttgtgtttttagtacagacagggtttcaccacattgttcaggctgggcttgaactcctgacctcaggcgatccacccgcctcagcctcccgaagtgctgggattacaggcatgagccaccgcacctggcctcacccagatatttttcaaatgccattttcgattcccactctctttcttgaagtaagcaaggcagacacatttgccaaggataactgagaatgtaagggcaatccatgactgggcagcttgtgcaggctgtgtgctaaatgcaactgggaaacatgccctataaatagccgttcattgtcagcatgtgtgaaaagacaagagagcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctactgataaaagcacaacacggaaccagaatggatgagcacggttttatctcaagaagcttcacccgacagtacaaactaccagatggcgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggtatgttgaggttgtctttattattcttactcagaaaggaaaatttgtaaatatgtttgtgtggctcaaactgatactattcttacaactgaaacattgaaaatacagaaggctgtatttggatattagagaggactccgaattgtttcttattattccaacaatgccagctgcatttgtaatcactgatggcaaaagagctatactcatttaaggaattcctatccattttatgaaaatcttttattttgccaaaaagagttgtgattcccttcattcgataagcttttctttttaatgtattttaattaaaatgaggttttataaatatggagtgcaaaaattaaaatacagtatttggaaattgggtctgatatctatttatgatttagtatagttgttactgccttaaaggtcaatgggaattttcagatataaatcttatttttaaaaagttcaaatatgtacctcattcatctttttaaagatatactgaatcctatctgaagtgttttgactttttaaagatagtataagttctatggacacgtacaaaatgttcatgagatatgtatttacatatcctcttgtaaattaatatgaagcttaaggacaccacttttaaaagtttgattgctgaattcagtgagttttaatctgtgctttttagatgctccataaacttagatggcaaaatgtaacacatctgctatctctgcataatccttagctttaaatagcctggcagccaatggaagttcaacacctgagcttacactgcgtgtctgagtttacacagcacatctgatgattggtgcttattatattctcccaaactactgccttggctcaaggtggagacattggtagaggttaaggactagtgccttcaacagctgctctgggacattccaaaggtttgctatctcattctgtatacattaagtatttcttcagaggcagtggctgcctgccttttaccccgcactgaatgtgagctgacaagcagcccaaggacagtgctaagaatagacatggaatgcagggtgtggaaaacaccagggcaaatgcagattgctgacagtatcccagtactcccccacgttgttttactgtagctcaagttaaaatgtaaaagacatgaagcaatagaaaaacgaatcaaacagttctaaaagttattttgaaaacaaatgtaatctgagaagaatgtttactgtctaattaaattgaaaagattttgcagttatatgcatatctgaggtttatgcctatacatggaggtttgtgtgtccaactcagatatgaaaaattttgtttgaccaagtgaatatcacagatcagcttggctgcataacaaagttaatagcagtcgttgagattccagatctactaatatgatcagaactgggataccatttgtctggattatcattctttcccagtgattggcagaatagtgtgaaaagaaactaatgtggtgagaaacaaaaaaaccctctctttcggccttgatcttactctagatgagatcctcctcccgggaaaattcaggaggtgaaattcctaccatgaggagccactgatagaaaatattctctttaaaaataaaattaaagtaaacacatgtctaatgagctcttgtttttacaagataaattttaaagtcttatagataagatatagataagttttaaagataaattttaaagtcttatagccatttttttgatttgggaaatataccaaacactataaataataaaaatcatctatggttcttctgctaccatgaggcagctattttaaatatcttgttcaacaacaggactacataaatacatgtatcacttttcacaaaattaggattatatctgcatggagtttgatatcctgattgtactggctactgtctgttgccctccccactcccaccaattcaaaccattctctgcccttctcagccccactctgagcccaagcaggctgaccctga

SEQ ID NO: 14366 - DNA, 18650 bp, Human
ccagaatgaaagtttctcctgctccaccagagagaaactgttgcctaggactcagctgaggactgaccatgaaaagatgggtttgaaggttgacagataattgaagtcccagtcctgcttgctggcatctgggttcccacccataacacactggaatttaaggttcctttcttgtgtcatttttcactcaccatgaaggaaaaataccagggcccctgcagggtctcagtctttgcatgtggatctttgagtgtcctgcttgtagggagaatagtggcttaaataactaaaaaggggcctggcacggtggctcatgcctgtaatcccagcactttgggaggctgagccgggtggatcatgagctcaggagttcaagaccagcctggccaagatggtgaaaccctgtctctactaacaatacaaaaattagccgggtatggtggcaggtgcctgtaatcccagctacgcaggaggctgaggcagggaattgcttaaacccgggaggagtggctccttccaagggctattgtgaggattaaaggtaaccacttaaggcaagtacctgacagcatctcaggcatattagcattcattgccatgatctttccccatcaggccccttaaagccctcctttccaccccttgcataaaaggcagactgactgacagacagctgctgtgtctagaaccattttatgcgcaggctaaccacactgagtactttcatgtacattgtgtcaattaaatcttacaaccacctgatggtgagagtcccagttgtgcaaagagggaactgagaaactcgctcaagttcacattgctagtgggtcacagttacccactatgcaatgctgagtttcccatccttacccagaagctgtctcccccatcacggaatggccctgcaggggccctggcccttcccttaagcacaccgtgggcaggtgggagggggcctctggaaatcccctaaaacaatctacagtgagggttggcaagcttcaggaggggtagcggtggagacgggatgttgagtaggaggggtgaaagtgaaggagggaggaggaagccaggttactaaaaaggaagtgcagttttgcagagcgctggcaggatgtggctggttagcaacacatgatggagttatcagatggatctgttctcccaccccctcttttaagcccatatttcattttcccttgggcctgagacctatgagtccagaagggcaaatcaggagcagccagctgagaagccagtcattttgccttcctcctggaggcccagaaaaggagtgcagttgccacagcaggtctgtcccagtgatgcccttggcagagccacatagggtcagggaatattcccgagtaaggcgtctggagaaggaactggggtgtcctcagggaagcccaggcaaggaacttcccacaggtcatctttcatgccctgtgtgcctcagcagaatacagggctccctcctgtacctgcccccaacagcaccgtctcctggagacaaggccgttctgcagctgccctcctctgtttgctctggtctgtcccacgtggccagcagatccttctcccacaaacatttccataaaagcaatcagcacgacataattttattgggcactggagaggcgggggtcacagagaaaggatcatagcacgcaatagaaaacaggaagcaatttgcttgaggtcactctcaaaatttccttgaccattcctggggatttctcactggatgttttcttccgtggccacagtgtccactgtctcactctcccacttttccctccctgcagtcttttctctacagggtcccaagactgttgtcaagctgctatggatgacccccaagtctttcccatctactctaattcaaggggacttaactctcacaaccaatatgaactttgggatattttcttcaacaaaaaactaacatccctcttataaaaaatcagcctaaactctcccccgtgctttaaaaaacttgcttaaaaaaacacaacaggattttcgaagaatcctttcttagaaaacaaacaaaaaaaccaaacaaaaacgtactttctccccactatgctgaatctgctctctccctctttccttctttctcttctccctccctcatccaccaagcatggttccaggaaacactagtaagagaaaaatttgtgtaaaatcaaatttatttcaggggctaattctgaagtctcccatgaagaggatgcaatattggatgtgttgatgaaaagacaaaacacatttgtgctgttctaagttgtaaagctgcattgactgcagttggtatcacatgtggctgcctgtaaaagagctaacaattcatgaatgtcaacagatgtcaacttacagagctcccaaccaggtgaaattaaatttcatccccatgtaatttctcttgtggacaagagacttagagatcatcaggccaatatttggagcttctaatgccatgactcagccttactttttttaagggctagttcgagaagctcaatgattcctttgaaattggttgatctctcagtatttcataatgctctcctaaagctcagttctacagtagggaactcgagctgaggcaatgctctgtgaatacacttctaacttttgtagacctttgcttcctccaaaatgtttattgtcaatgtagatcttaaatttcaggtcatggatatttgccattgcttttttagtcccaaaggatgcatttgttccttcctctttccttcctctctggaaggaagcctgcagccatgtcaaatggcccatcattacacaaatctggaatgaaccggacgtggaggccaccgcagtatagcaaagcatttctcttgcagacaatcaaatacaggtggcatcattttgatgatgtctgctttctcaatctttttttccagatgggtattatgtttggttgggctatgtctctggaacactatttttctgcctctctgcctgcaaaattcttactctgtttatgaagcagacagaaagtacttctctaggaagccttctccacctctgggatggaactggtctctctgtttcctctgggccctgacagtaccttaagcacactgtgtgataatccaaactcttcaagtattgcatagctattcagagcctggttcatcttgtccctaggctgttttgggaggaccccaaggctgcatccaggctcagtggtggaaacaattctgcaacagattgaggatgtcaccctaggtgccacagaggggagcaatggcacaggtgctgagtatctgtcatcttttgcagaacacttactaaatatttgaagagtgcttaacaagtgacagcaattgacaagcattttcctgagtgctctaaccttagggaacactagctgccaggtttttttgctgccttgtttctacgctgccctataccctcccggggtgggtagttcaccagatgcagttgtaactgaagcaatgccagtccctccacactcaaagccttttgttcctatcataaagagtcagggtcttcaagtatgtcaacagtatgagcccatgacctggataccaggttgctggaagtcaagggatgctctgcatgtctaggaggtgctggctctgccacgtcagcaccaaggagaaaagaatcctctttacatggctgctgatgaacttctcactgaaagcagctcaatatccgtttttccgtcccaatcaaagcgtgtctcgccttctcacagcttgaggctaccgttttgacatggtctcgcttcctgtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccaggtaagctttcattgagatcttccaaaaggaagggtcttttgaaaaaaggtgcagggataagataagagcacaaattggcctgaggatcagagtgctctgcattgacatcaccactggacctggctgatcaacagtcaagggttccaggtgctgggcagcagcaccgtggaggtgctgtccagggtggggagcctcctgggtggacgggtgatgctgtgggggtggcagcaggaatgcaggccattctggataattgggaggatggagcccttggaagaggtccaaagacacacccacccagccatcctgggcagctacctctagggtgccaacattccagttgcaacagtcctgctgcattcaggatttctgagtcagagaatgcaacgccagaaaagtataaatagcatctaccagtggtcacctcctccatgaggtggatagcaagggtgtgtccacatggtacacctgacaatgctaagacatgacttgaatatttatttgcttgctagagagagcataggacttgaagtcagggaatcctggatctgtctgtcattagtatgattctgagcaacctactttgcctttctgagcccagattcactcatcagcaatgtgtggaagagcacgtagaccccaagcatatgatgcattcagcaagcacacattgaatgctggcttcgtgaggccctgtgctagatgctggggggagagagagaaagggatgagaccaggtagtcaggtcctgcctccaaggagcaactagtagtggcaggaaataaacatatagactataaaacatatgactgtttgagtaacactacagaaaagctcatgaaagacttttggagggctaagggacattttggaaagatctagcacatctcacccagagcagaggccctgtgggtggaggctcctctcccttagtcaccctaattgaggaacattctagcaaaagcaaacgcctcagtgtttaactgacaggaggttgtcactccaatctgcaaagggcttgcctgtggaacctctgcctcctgattctcacaacagcaccttacagccaagccattcaaaaatgcagaaacaggctggaggcctgggctcacttgcccaaggccagtctcttagattgtgcagaatttctctttgatatcatcaaggtgtaatgctccatgattcacttcttttgaaacctggcattgagacaagggacaggagggatcagagttccttcaactgggttgcgttccagtagcaagcatcccccaaggcacacaggccagcctccctctgcccctgggaaagagagccaggacaccctctcccttacccatgcagatatgatgctggttcaatgctggcttctgagaaagactcctatgtgctccagggcatgcctgaggtcctggctggcacagagcaggttgcacattgcaatcccctgctcatcacattcccaacacccaggctgcatcccaggtatcttcagtcagtacctaggggtgggcgtcagtatttttcagggccctccagattccagtatgtagccaaggtggagaatcctacttcacagattcctttctacctggaaccttttcatcagcttttgagggagggaaaacactcctttgccgagagcaagctgatcaatgacctgtgtataggcagagcagcaaacacacggcttcagggccaggcaggtacatacatgggaaatgctggctgggtgagagggagcgtgaagagctgtgggaagccgaagtggccccatcagaagctgtgcacaggcaccttgtttttaatgacacgggtaggtcaaagcacaaacagctgccaactcatgacctttgtcttaaaagtttaaacggcaggagaactgctttggcttttacacatttaacatggtatcttggaggctccttagtgcagtagaaaggacatgaacttcaagagtcaggagacacagggtcttgcctgagcactgccatcagatggccccttacccttcttgaaatgtaatatgccagaggtcggcccagatattctctgagcacccttccaggcctaaaacactaggatactgtgagattaactcctacttctggtccttcactcctgcctgttggcagctcagtcaggtaatagcacctggagttcacccacctgggtgtcccccacttctgctaatctcctcctcttgaatccttcttgctgttcagcttggaaactagaatttaggaagaaaagtcactgtatgatgtaatgcacagctttggccttgtttctgcactgtagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaagtgagtttctacacccggtgtttctctttacctttctcatctttttctttctcatctttatttttaaaaataatcctatatataatttaaaaaattcccagatatattgattaaagaattgttctgcctctttctttccatgtgtgtgcagatgtctgagtgtgtgtgtgtctgtctgtaggtattacacctctgcctttcacattaaggaggagttttcacaacatctggcttcaggagggctgggaggtaggaggtgggactggctccctggtgaattgctcatgagggctgacatacgcctgtggagatttggaaggttgatgcacatctgaaatgtcctgcggttactcagaaagaccagaatgaggccaggaaattatccatcaggaattcttactctccaaatggaatccacttgtactctgcacgtgggttcaactccctcgtcagggagttaggatgtctgggtcctagtctcagcttaggcactgattctgactatgagcaggttctttccatgctcaccctcagattccttgtcagttgaaattaggagatggatgagaccttctatgcagaaccaagaggatgtcagacgtgccatagggtccctgctgtagggctggggcttggtcttccctctgatcaaagtagctctgcatttattagttttatttattattcttacactgctgggaaatatctgtagagtgaaggtatgctagtatctactcatagatttgttgcatcaaataatatgcacataagtgcttggcaccacacctgggacatagtaattatacaatcactgttacctctttttaatattgttgttcatactgtgtgttgtttctccttatgaaagcctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaaggtaggtttcctttgtaagcatctgcagtaaccaatggcttattatggctgtgtggccaccttagttgggccagaggggaagtagcttgagtagcctgctcacatcagacccaggttgcgtcctgtgatggtgggacactgtagcacttgaccacagtaagaccttccatttgaagagagccttttagcttgtgaaccactttcagtagattgacttcttgcatcttcttttgtcattttataaatgagaaaggtaaggctcaatcaaggttacagaacctgggttttctgtctccaagttcaagttcagtgctgtttccacattccatgtgctgctgtcctggcatgtgtctgttgtgggatgctgtccattgtaaacaatgtgggttacaagagctctcacctggagctttcattatttccactgtgcatggagaggtggctgatcccagggctcacaagtcccccacgcttcagtcaagtcattctgaaagtctcacttcccatatgttttctgagcatgacccaaaggggtgtggggaggaagtggccaggctgagctggggccagcagtcaaatgagctcaggctcatgggtcctgcaccctctaggtgctgccccaggcctccgtaggcttttggcactagaatgatccaggctaggatgagaggataaggaggttctcgttttccatacaaggaggcctcatagctgcaatttccacatcaagagtgtaggtgagtctgatgagcccaaggtgctgctgtgctgagattctttcgctgtggctttcacttgtcacctgggaccatcatcccccaggatcttactcagtgcaaatgaaataacagaggcagagcgtgtaaaacacaaagagccatcctgcctgagctgctctggggagagtatttgctttctaacatgagaagagccttctacaaggcaagtaacctgatacttgggtaaaagttgagagagttgggctagtgttggggcttggaggtgagggtgcagtgaggtacattcatccttccatgcctttgggtcttaggggctccaagtcttaggatcatagggacagctgcaagtcaggtgctctagtgacgctgagcaagtgaattctttgacataagtttactccttagtgccaaggtacaaacaggtgccccaagaacctgtaggtgtactttatttggtctgcatggtgatgaaaaaaatattgaattctatacatgataaaacctgaattgaaacctggactttagggaagtgatctggtagcgctagttctgtatgcctacgtagagctgaccctttgagcagatgtactcgttggcgctctgcagttcctatcacacatctgcccatttggctcattttagggacctgcctgactcctataggcatctgagtttgagacccctgctctagactggaataggagtctctgactgtgtcctggctccatgggagtccccgtctaggctaggaagtaccgtagtaatgtgtgtgtgtgtgtgtgtgtgtgtgtgtcacacttgcacactgtgcattggggcaggatgttagctgggcttccttagtgctgctgctgtgacccatggagaagtagaagggaagaaggagcaaccaattcctgcagaacagcactgacccctgttttgttttttgttgttttttttttttgttttgttttacctgaagtcctacaacctgacttcatctcacactgtccaatatgctgatttctggctgacttcatggcactccccctgcccggctgtggacagggtgaatgagagaggaaaataattatgcttgctgctttacatacattttttttttcttctaagcttcccatgactcctgaaggtccattctttacagatgaggaaactgaggtttgaggaggtgatgtaacttggaggctggccaagctggggtttgagataacaaatcagtctgatgtcagtccgatgttaaattgttcatcctcttgcagtaaaatgtttttgaatgtatgtatttcctctgcagcaattagacggcatccatgtcaccatcttacacaaggaggaaggtgctggtcttgggttcagcttggcaggaggagcagatctagaaaacaaggtgattacggtgagtggccaagtgaaggggcatgtcacagccagaggcaatggttctgggggagggggacacacttgccaggaaggggccctgtgctggggaaatgaagaatgcatgacactaggccactgggcaggtcctgtccactcagcacatcccagagcctggggctgcgtggagagggtagcaggcctggccatgggcatcttttcctgtgggtcccactattctggctcatccaatctgatcagcattggctgctgccttcaggtcacctgtacctgacccagatggtttctggttctgccagttttgtggagccatgctgcggctgctcgctctctaaagccgagtgcattgctgtcatcccagggctgtgttgtctcagggtatcctttgtgtaggctgtgctgggctcatttgaatttccatgcccaactgaaaacaaatcctccagttcacagcatcagccagcattcaacataccacacccccttgcagtggcaatctggcatgttcctgcgtgtcacttcagagtcaatcatgtcagtggtgacttccttgatttcctgataagttttctatcacataaaaaacacttaaaacctgtaagtctctatttctctcactgagtgcagctgagtattacaaaaagattcctgaccgtgtagtttactttctacttgaagaggaggaaagagagcttgcctgtgggaatggcactttgggtatttttctctgtccatgagtagcaacttctgtccacgtcatctggccagtcacccttgagacactgcagacaacaggaaactaggaggaaggcgcacatgttggctgagcacatgcacaaaagcttctttctccttctgtgtttgagcatttctcttcctttccagatgattaaaagggaactaacgtagagcaccatccacggccatgctgagcactcactgacctgttgtctaaattcatcctacccacactttggattgataaattggtggcatttatgcttcttttatagaggaggaacctgaggttcctcctttaattaactttaatcttcgttggcctaaaaatcctctagcattgaggaacctgaggctcagaggagaggttctgcttcatgcttggatgttacagcctggggattctaaccatgtaacagaatttttctaacaccaaaacaatttagagaagcaaagagctttgctcctatcataaaagcaaaactacaggtaccacattttagtggtttccatgcatgctatcactcagtcctcttaattataatggacctcattaaagaggctgaggcagagacatgagatatttttgtgtgtttgtttatcccacatatcttgcagaaaggggaccaagaggtgactggaggtaaagagtcagaatttctaggggaggagctataaaaatgtctagactgcctaggagagtgtttctcaaaatgcattctgccaaatgagaccgagaatttctctatgagaaaagaattctttgttgaaacactttgggaatccccataataccctgccaatacttagaaatctgccatgcagatttgcattgtagaccctctaaatgccttttgcttagaaatctgctgccatgcaaatttgcattgtagaccctctaatgccttttgctttttaaaagtagacaatgtcagagcttttgtttcacccagtattcctcaagtttctttgattttaaaaaatttttcttggccgggtgtggtggctcatacctgtaattccaacactgtgcggggccaaggtgagaggattgcttgagcccaggagtttgagaccatcctgggcaacactgggagacctgtctctattttttaaaaaataataggaaaagcctttttcttacacaatacccgttaatatgccatagaatcagtgccttgagaaaactactctggggacttctgacctagggcaggtgaagcaaaagattttatatggaatcccaactagaatcgtggtggtacactataggacgttgtgttgggatggattctgagggcttacctggtcattactgctggtgatctctgctctggatggagaaggagggaatgctggcctctgtgccagcagctccaatctaggacacaattatctttaatctttgttggcctaaaaatcctctagcattgactaaccggttcaatcctcctccagcaagtatgtggactggacttgtgtgatttctggtcctgacttcctttggtttgctcaggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctagtaagttctcccaactcagtggaagccacatgggccacatcctctttggccatttggggccagacctgatggggctactcagtaatttgtgaccccaagaatgtgtggctgcctagtacactgcctgagacgtgtttacatgtgcctgtgtgcaaacacgggggctgtatcaccccgggctcacttgaagcccagggcatctgtggcctgggagaggagaggatccctaacagagaccttgtgtttttctcagcagcagaggccacagtctgcacggtgacactggagaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaattttaaaggggtgccaaaacactcagtaactcagatcgatactattttaatgcagcgtgttttttaaaattaattttaaaaaaacatgttggacaaaatatccaagtttaaatcaagacagagtctgactttgtactgcacacttggcctcatttgccttaccctagtcctggacacgtcagctcctgcctttatttaaaatgttgatagatattttgttcatcagggattggagtacaaaccagtctgatatgggggtcacttggatttccctgtgaaaatcatgaatgactgtggctaccatgtaaaaccatccctgattctttggtgttcctcaaattggaggtctccaagccacagagcaaggggttgtagagagaggagtactggacagggaggcaggtgggccaggttctagtcccagctctgcctgtaatgtgctgagtgacccttcccttctgggcctgaggctcttcatccataaaaggaggtaaagaggtacaggtgtgtgtctgagggctcttaggactgagacccaaagggactcttagctctgtccctcacccactatgagctcctgctgctgactggtttcgttagaggaagttctgctgcggctgcagaaacccagaaggtagagtgaggcttacatggcattccccccagaatccatgttaaccccaattctgggaaagatatttctaatttttgaaggtcaatttggaaggagcattgggttcaatgtcaagaggactagattccagtgttagttctgccacatgaccttggtagcatgatcttggacaagtcacttcaccaccatgggcccatttgcttaaatgtttaggatgagactgccagctgcagggtgatgttggaaggagagatgcagattctggagccagaaagtctgggttccagcccagggcccaccactagcagctatgaagctctgggccagttacttgagttcttggtttcctcagctgttaaaaggaaacacaaataatacacccctcataggattactgtcataaatgcaaaacattagcacaacgcctgttaaaataattgcccaatacactttagctatattttcattactatcattagtattatcttctactcttatcaggatttgtgaagatcactgtgtcaaatggatgggaaattttattttaatataaacagtaaaatagcattgttttcacttgcagctttgaaatagtgggggccatatatggttgtttccttttttatgtggacacagaggacttcgtgccagaggcaagatccctgtaaatattgttgcacaaaaatctcactagctctcttcccataccacccaatgctgatgtcctcaccacatgcggagaacaaatgtgaagggagtaggatattgggtcagtgtccaaagcagggtctgggcaggactcagctccccagagtcctctatgaactatggacggtgctccaggcaggctaaggcgtggagctgcctgatatttccctcccctggggacagcaagggctatccctttccaaaggccatggagagctggagcctggtgccctaacctctgagtcaccatcttaagagatgcctcattttagaaccaccaacaagcaagctcccaagggatggtgccctgttctctaccaagctatcctggctctttggagatcaaggagaggaggcaactttccttgttccccatcatctgtggaacccattaccttctccctcatttcaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaatt

SEQ ID NO: 14367 - DNA, 8190 bp, Human
ctttcctttttcttttcttttttctggagatggagtctcgctcagttacccaggctggagtgcaatggtgcaatctcggctcaccacaacctccgcttccagggttcaagcgattctcctgcctcagcctcccgagtagctgggattacaggtatgtgccaccacacccagctaattttttgtatttctagtacagactgggtttctccatgttggtcaggctggtcatgacctcttgacctcaggtgatccacccgcctcggcctcccaaagtgctgggattataggcgttcttatgccatacgtttagttaacttttggagtacttccatgggactatcaatcaagacatcctgccttcccctggctaagagtgaaagacagggtggagagggaacttgaaccaagagaggtcagtcaaaatttgtatcacgagcagagtcacaaacagaaattggtggaagctcgttcactgcaacaacgttgcctggataagaacttctaattcctgttaggcagtcccaatagtattgttaagttcctgttctttcagggctggctttacttattttgtgagctactccatacacttctaataaattccgttttagtttaaattagcctgtttgtttctgttgcttgtaaccaaagatccctaagtgacaaaaatgtttaatttcctgcttgatttagttgatgctacctctcaactttgtatttttgctattcacttaagaaaagcttgtacataacagttactattaaacaagcacctaatatgtatccaggtgcttcatatggataaactatgtctagtcttaaaactctgtaaggtaaaaatcatatatcaatataatgtcttttggtagagtaaaaaacactttttataactataattaaggacaatttgtaaggttttctctcctattggaataactaaatccaaaccttgtttttgagggttctcattatgcaaaccaattatttttataacataagggcctctagggcagtaaacaataccttctattcccagctatttagcccagaggtggcacttcccagaggaagggaggagaggtggaactctcatccaaattcaataaggctgtgtcagccaacttcagcgagacaaagctgtacataacataaaagcactttacaaaccttaaggtaaatcacattcattttggtataaaaacggcatgaaaggaaactttctgtcaagtgtccccagtgcatgctagttacaattcataaagctccctctgcgttagtactgtattcatatcgctggtggtgacatatacaactgtgttcaaggatggagaccattttcatccagtatagcaagtgcatgcagttatgcttgaatatagccaaaacctggaagacgttaaactaccagcttggatgaaaattaaccgtctcaagtactgaggaacaagcatgaacctttctcaatccaatcatctttccttataattggcggcaataaatctaaggctcctatctcctgctatgtcgctttaaatcatttctggaaggctaagacatataaattaaccaccatccctgccgcacgcgtacagcaaagtcctttccacctccagattcccttcctcccaccgcccctagcttcatcgcctgcaggaacacagggctcagcaacgggcccgagctctggctcccggcgccagacgtctgcgcggtgccccaaacagcttgtcaaaaagacctcgcagagagaggttcagagctgtagctttccagcgaggctaccatgcagacccagctacgaaaagtaaaccaaactagccaaaaccagcccacaagggccctcttctgtttcagcggggcgggagcggaagctcaggtgggtcatagagttctctagttctggtttccggaccgcattcggaactagagcgcctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggtaaggtattaattcttggaaaggttttagggacaactgggtaaaaaacaaacgaataatttgtgcttatttggtagcctagcgtttgaaatagccaatttgcaaataacttgtatcccatgacttaagagttactgagtctctgttatgtgtagagacctgtactgaatacccagcatttcagggtccaacagtgacttatttaaaacaaattgtgtagactttagaggaaaagggggaatgtaaataggtgtagaacttgtgtaatggaatgaatttcacttattgctttattttgctttaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggaggtaaggccttaacatttccaaaagatctttagttagtaaattcgaaaatcgtatcccagttttgtaaaattcacctccctgttaactttgtggcatttcatagagtcatagaaaagctattccttgtgtccataaaacaaggactgtcatcctggtaaccttcatcattctaggtatactttagtgcatacttgctatgtcccaggccctgtgctaggtgcttgctttacgtacattatctcaatcctcaacacaacccaatgaagtaaatgtattagctcacagttgaggaaactaaacccaagcagttaagtaccttgccaaagtcacgtaggtacatagaaggtggcagagctgggattcaaaccaaaccaatacaattctaaagactgtgctctgtgagccactgcacccagcctaagactgtgctcttaatcatgatgctgtgctccttctagttcatatttgtgttctcctacaagttcaaatatatacattcctcaatactgctaagttttttattaagtgaattgggtttttttttttttttctggatcactatcttccactaaaaaaagggaggtctatataatcaaattctctgatttatctttcaaaacacaaaaccaaaccctaatcatgttactaaaaacaaagcttagctcctatgctcctaaaatattgtaagttagaatcacttagaatagatccttaaggagatagtaccagtctaccaaccattcagtcccccagtgattctgatgaaaaatgtaagaattgcatttatattagtcactttgtaatgatacctaaataaagtttctctctttgcctccttgttcttttctcccaacagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctggggggggaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagactacctttgactttttgaggtgtttttatatttaacattttgccaattcagtagttggaacaaaaatcctctgctccgacaacaagaattcagcctcatgcaaaataccttgcatcaacttaagaaacacttaagttgcctatgtaggagcatttatgccattggattggtagactggtgaaaacatgggttaaaaaaaaatcatcactagaagaggaaggatgaaaatgatttttaagagcctctgctgacataagtgttttccaatactttaactcattttaccagttcaaagcacattctctgatagcacaaaggtgataaagctaaaattttaaatagaatatcccatggattttaacattaagacatttatgatgttagttgagacaataaaaaaaattaaaacttttatatgccataagaaaagtataatgaattttaaaattctcattaaacctcaaaggttttaccaaagcaaatatcatggttaattaaacatttttatttatttattttttttttactgagacagagtctcactctgatgccaaggcttgagtgcagtggtgtgatctcggctcactgcaacctccacctcctgggttcaaacaattctgccacctcagcctcctaagtagctgtgattacaggtgcgtgccaccacgcctggctaatttttgtatttttagtagaggcggggttttgccatgttggccaggctggtgtcgaactcctgacctcaagtgatccgcctgccttggcctcccaaagtgctgggattacaggcgtgaaccactgtgcctggccaattaaacgtttttaatacagtaataagtgaataatagaattgagccagattcaggattgaaatgatgtagtcctccatgaagaattcaaagcaagagttttcatctcaacctaaggaggaaaacatgagaatatcagtaattcaaaagaaaataaaagaaacatcttaaacataataaaaccagtgtccaaacaggatacaacacacctgtgtggaaaaaccacaatcagaatcagctcagagagaagattaagagatcataccctggtcaaagccaacagtgaagcaatggcaataccaggtcaggctctacttcactcatcatcgcatcgctgcatttcatctccttgtattacctaagagcaacccagtgccctagtttcacatccaagaaaacataggcttacctatgaaaaaaaataaagccttctattcaggtaagtttcaaccatgggtttctaattaatatttctttctttctttttttttttaagacagggtcttactctgtcacccaggctggagtgcaatggcctgatcatggctcactgcagtctcaacctccccaggctcagacgatcatcccacctcagcctcccaagtagctgggactacagtcacaggccaccatatctggctaatttttgtactttttgtagagacagggttttaccatgttgtccaggctgttctcaaactcctggactcaagcaatccaccttctccagcctcccaaagtgcgcggattacaggcgtgagccaccatgcctggcctgttttcaattaatatatatatatatttttattttgagacaaggtttcactcttgtcaaccaggctggagtgcagtggtgtgatcatggctcactgtagcctcaaactcctgggctcaggtgatccaaccaggtagctaggactacaggtgcatgtccaccatccctggctaattctttttaaatttttgtagagacaagagtctcggtatgtttcccaggctggtctcaaactcctggcttcaagtgatcctcctgccttggcctcccaaaaccctgggatcacaggcttgagcccataagcctgcccttagcctagttcaaaagcaaaagctttagaaaatatattttctttttaaaaatttctttattttttctggagacagggtcttgccctgtcacctagcctggagtgcagtggcacgatcatggctcactgtggcctcaaactgctgggctcaagcaatcctcccaccccagccttctgagtagctgacatctcaggtgagcaccaccacgcccagagtcttgccatgttgcccagggtggtctcaaactgctgggctcaagtgatcttccctctttggccttccaaagtgctggattacaggtgtgagctactgtacctggcctagaaaatatttttttttttgaaatggagtctcactgtgtcgcccaggctggagtgcagtggcgcaatctcggctcactgcagcctcagcctcccaaatagctgggactacaggcatgtgccaccacgcccagctaatttttgtatttttagtagagatggggtttcaccatgttggccaggctggtcttgaactcctgacctcaagtga

SEQ ID NO: 14368 - DNA, 143164 bp, Human
taccttttaacttctctgtatctcttaaaatagaggaagtaatagtacctacttggttatcaggtggtgcggatgtaaaaatgtacttagcagagtaactgacataaaatcataataaatatcaacagttatttgtttaaaccaccatcatcgtgtggctggatcatgtcaacagtttcctgagtggtctcccattagattatgagcccgtgatggtcccaaaaggtgaaaagaagggagattggtccatactttcacccaaaagtggaagagaatgaagttggaaaagctttcggattgatgctatattttgaaaatagtattggttcatttttccttaaaatatatgcatttttcagagaaaggaatggaaaataaaacaaatataaagaagataacatttgtaatcagcacccagagggaaccactaataggtatatatactcctctggatttagagttttgtatctttttttttttcttatttcaaagcatttttctgtatcatatttttcaacaatatgatttaaaaggcacatcccaacatagaaataaatacatgttcattgtagaacactttgaaaaatacagaaaaatattaggaagaaaaataaaactctcactatcctgcaataaccacttttaacgttctgctgaatatccaagctttttttttttttttttcttttgagatgagtctggctttgttactcaggctggagtgcagtggcgagatctgggctcattgcaacctctacctcctgggatcaagccattctcctgcctcagccgcctgagtagccgggattataggcgtgtgccaccacccccagctaatttttgttttttcagtagagacagggtttcaccacattggccaggctggtctcaaactcccgacatcaggtgatccacccacctcagcctcctaaagggctgggattgcaggtgtaagccaccacgcctggcctatcctagccttttttttctatacatatatagtcatactgtatactgtattgtttggtgtcctttttttgcttaacactttatgaattttctgtcataaaatattctataacattatgcagctatctgatttaccataactgtttgcattctctcaccttatacctggctttctaatttcccctattcccctattttaataacagaggaaataataatacatgagtatgttatacaaaattttaatgtacttctgatcacttttttaagaatgaagttttaaaatactgaaacactttttgactcacagagttcataggcaaaatgtgagaaaaatcatcactttgctctccatccttccttacaccctgaaattaaccttagggacagctagttcatttaacatcatcaatcttgttctccagttccaggtcctggaatctagctcttagtgtccgaaagaaacttacttttgtgtaagcacacctattatatactaggcactttacctaatttatctggtttaaacttcacatgcccgagagagatactatcattgtcttcatttcacagataagaaggttgatgagacattaactgtctcagtcacattcagggtagggattcaaactcacatccaatgcctcctcaacctcttttacgtgcagcactatcctctagccccactgcccgtatataggcctgggctatatcaccattgtccgcccttgagcctggaaggaaaatgagctgaggggttttgttttttcagaaaggaacaggatatttcatcatctctatgtttacgtttttcagagaatttctgtgcgaggaaacaaatccattgtcagctttttaaaatatatccctttggagtagccacttaacatcctctgaggcccagatgggctagcttgccgggaccaaaggaaatctttgggtctggaaggcgacaagagatcacaggctttctaggtctaccgcgcaccccgatgacgtcacgcggcgacgttctctgacgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtagttgggggcaggaggggaagatgtgtttcggaattgagggtttagggggaccagaggccaggggtgtggctgatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtaagagacaacctcttccctgctccgtaatggaggagcatatcgctagaatcttgaccacctggggaaagaagaggcattccttactcttggaggaaggaaagagtaacctccagaattgacccgatgtaagagagggggaagcaaatgggggcaaatcttaacccagcatctttttttttttttctttttctgggctctgcagtaatggtctggtttgggaaaggctgtagattaagctgaaagtaaagaaactggaacgtcctgttatttccttatcatttgaatccaaatcatttgttcatgctgcttgttttcaagagtagtcttctattggaggggtggggtggggggggacaggcctttattgaactcacgcggatgcttcattaaacttttgacttttattttattttatttttgtatttttagtgacagggtcttactgtgtagcccagtctggtctcgaactcctgggcccaagcgatcctcccgcttcggcctcctaaagttttgtgattacaggcgtgagccagcgcgcccagccaaacttgacttttgagaagaaaaaatgttttgaaaactgccaaagacttatcataaccattgtggtttaaaagaaagtaaatgcattaagcttagaaaggcagaatgactaagaaagaaggtggtctcaatgagaatcaatttaaatgattagttaccttccttgtatacttcaattgcttagcctcagggtacacttacaaagtagtaatagaaagcagcagatgaaggaggtgcagctctataagaaaacgtgttaagacattccagtgatgactaagcgtgctggtaaggtgagaactgtttgcagtatcttagccgttgaaactttcaaggaagcagaaaggatgatgtataatgcaaacatcctcactaaaagctgggtggtaaaatcaatataaatctaatattctgactgtgtatgaagaaactcaaggaagtccagttctttcattctttctttccttaaaagatccatattttgaaatactaactttttaggcacaggtttgaacgaagctgagcaaggaatatattaaatagggcacgttctcctttctcttgtcctttctttccttctagccttaggttttccagagtttaatgttattttggttaagaattagatgtaaaacttttgaactcctttgcttcgttataatattaagaagctactttgtagtctgttatgtttaaatagaaatcacaggtgattttagcttttgtgtctcataatttcttatgagcaaggtaatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcagtttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggctttgcttatttctctggctcttctgaaggaacattttctccccccataggagcagcttgatttttgaggcacttcagcaaatattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccgcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtcttctgatttgtttttatttacactattttcatttttcttggagtttcttttggcttaaggcaagaaccagcttggcaccatgtttctctgccaatatggttagggaatattttgttactattgtttacaatatggttactagagtgatatcccttctctttagagcagcagggactcttaatttagaatctatcttataggcttctaaagatacttgaccctcctctcttccctgaaattttgtgggtgggtgcattattttctagttaagacaagaacacttaatgctcacagtgaacaggatagtaatatattccttgacattgaaattgttaggggagataatgaaatatgtgagctactgataaaggtatgacttaagacttaggttaatttattgtttaatagaatgtagtgaaaatgcctgttaagaatttactcatgcctgtaatcccagcactttgggaggccgaggtggatggataacttgatgtcaggagttccagaccagcctggctaacaaggaaaaaccctgtctctactaaaatacaaaaattagctgggcgtggtagtgggtgcctgtagtcccagctactctgaaggctaaggcaggagaatcacttgaacctgggaggcaaaggttggagtgagcccaaattgaaccactgcactggagcctgggccacagtgagattttgtctcaaaaaaaaaaaaaaaaaaaaaagaatttaatgggctgggcacggtgatcccaacatgtagtcccagctactcgggaggctgaggcaggaggattgcttgagcccagaaggcagatgttgcagtgagtcccagctgggactacaggcatgtgctaccatgcccggctaatttttgtatttttattagagacggagtttcgccacgttccccagactggtctcgatctcctgagctcaagccatccgcacgcctcgtcctcccaaagtgttgggattacaggcgtgagccaccgtgcctggccaaaaaaaatttaatatgtgtatgtataagaggcttttcagagaaattgggtgacaaattctaaggaggttttgttttaaaatcttaaacaagttttaaaggacatagcatagcatagtaaatatcctagacagattgtaatggatttgagctatagtccttctttgaggctcaagtaatcgtttctgtttactggtttttctgtttgtatatatacattcataaataacttcagatttattccaggtcttttatgtgaagaattcctttcttcatttgcccacttcacatttagtttacattatgaatggactaaatgattataacattctttgaatttttgctagaaacacattgtaaaaacattgcataaggcaagcttcagtataatttttaattataacaagtattaaaggagaaatttctatattctgtaatgatatttgtgagtcctagctcacttcttttaacaagatcattctgtgaatttctggtacaatctaaagagctattaggatcaagactataaatagtaattagctggttggaaagatagcaaatgagtctaatttccattaaactgtacaagtagcacgttttagagatcagatttgaaccagaagtttttcattattttatgtttatctggctcttttttcttttctttaattacattgatttgtttggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtctgaacggatgtctcagtcttttgccttgtttttaactataaactggcattatttgggaatactcttgggctaaatctggattgttggaagtaagaaagccacatttttttttaaatccaaaaatatagttagatacaatgaataagatctagtatttgatagcacaaaagggtgactgcggtcaacaataatttactgtacatttaaaaataactaaaagaatgtaattgaattgtttataatacaaagaaaggataaatgcttgaggtgatggatatcccatttacactaatgtaattattatgcattgtctgcctgttatcaaaatatctcatgtacctatacgcacctactaaatacccacaaaactaaaaattaaaaaaaaaattccatgcataagtcatggttgcctctctagatgtttgttgtgaaagaatattgtcctactaattttgaattttttttttctgaaagagattctttttattgaaagtttcatgtcatagatcggcaaaattgttttttcttttgaccttacactgcttcagaatatatgttttggagtgattccagcttgaggcaaggaagttaccagattttcctgaatggaaagtaattgcagatatatttataaaaaggtccagctttagctcttgaaagctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattcttttctcttgctataggtgcacattaaagatccaaagtcatgactgactccaagtatttcacaaccaataaaaaaggtaagtatgagaatacaatcaaatcttttgaaattttcaaaagttgtagtgtaagattgccccaggcagaatgttgctgacctcttccttcagacatacatgtagctgacaatctcactggacatctactacttctatagatgaatgtattcaagcaagttattaaagagtaggttttaaaagagagggctgtgatgcacattattatgacttgaaggttctgtttagtgaaagagactcctctttgctgtttgagatgatccattggagattggttaagtgtgaggaggacaaaagaagcagcatactttttcccttttattaaataatttttacttggaaataaacattttataacaaagaatacaattaaagcaatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgagggactttgcacttattactctcatcatctttgttatcagtaatataatgcttgtttttacctatgagtttgggtctaggaacaaaggattcttcttgggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattccagacatggcgccaactaccattcttctttttctcttgttgcagtgagttgcttaattatgtcagtttgttgtctgtagctttcaatcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaatttaaaaattagccctgtatggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtagaatatatgactttgcctcttttagtacccctctttggtcctgcccaactttttcctccttatttttattacttacacctcacaaaagccattagccacttgtcattcagtctcagctttttctgattttcttttggaaatatgtttatttcttcttctgttagcattttgtgtgctttgacgaacaaaatgtctataattatataaagggatacaattacaattaaatagttataattttaaaactctcctaattcttcaaacctactcttgaaaagtgtcctggtgacctttttttaattcaggcatttgtaaaagtttgagactgcagattgaatcactgctaataaacatcatacttaaaaaaaattgatagattgtgttccctgtacttcctgcaacacccaccagaactgccactgaaacatattctttaaatttatgcttttggaattggaataatttctgttacatcctgctttgattctataacacctgctgctgttcacaattcagactttctgaaaccccgccgtttgtccttcactgttcccggaagtgaatgagaggaactctaagagctggatttggcaggatgggacatggtgaagagtcctatgaagaatgactctttaaagggcccagcttttcttgctatgctacttttgtagctgttgattaaatagaaattttggaacaatttttttgccttattggccatggatattgaaacgaaaaagtgctctacttctgtgtcttactaatttcatcctttccacataatggtttcaggcaaatcacgtagtgtttgtccccactatttctttcttttttttttttttggaggaggggaagtcaggttttaatgtcccagtcctcgggcgccgtcatcccgcgcctgccaggcccggcggccatgtcgctcactcgggtggcggccagcctgcctcatcagggccttccgcggaggccgccccgtcgccctcgagcaccagcttcacgtccagctccagctgcccggtgtagaagcccacggcggcgcacacccagagcgggctggtggcgagtacagcgcccgcagctgcgccccctagcgtcagctgcatgggcccccgcagcgctgccaggccccgcaggcgctgccccacaccgcacacaggccgcccagcaggaagaagccatatgctgcttcgtgatccatgtcactctgcatgaaggagataaccccgatgcccgatgccaggaggccattgtggaaccaggagaagaaagctgtctcgtgcgcctttcggagaggagcctggcgcctgcacggtccagctcggacacaggtggcggcgaagccccgttgtgggggccgtggccgggggcgaaggacccctgggcgcccccgctccggggccactgaggcagcagtagcgacctccggaagcggagactgtccccactgtttctatgctggtaaatgagatctggttgaaaggaacgacaggaacagtcttgaaggtggaggaaagtcttttgaggcagtatggtagatgagctggaggatgtagatggaaagttgagatgggagtagtcaacctctttttcatggacttagtgttttttttccgtttcttttaaacaatattagggttgttactttcttttttattttggttccggcttcttgcagataggtgagcctggagaccaggccttaaaatagtggttacagtccctgacagtttacagtgcggagcctaagcagtcattcaagattgtacctttggaaatgactccattgtgtaccattcttggtttcaagattattcttgtttgattgaatagcaagggccttaaagcccactgatttattaaagtactgattaaagtagtgattctcaacattgggtgtgcgttagagtcacttggtggagctcttaaaggtataaatatgagttctctttgacattatgatttatttggcccagagtggagcctgtactttgctatatttagtatttctcaggtaatattagtgtgtggccagggctgagaacctttgcattcaagagtcaggagacacagtgctaagcccaactttgtcactgactctgtgaactttgagcctcatttcttaatctgtaaagcggagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttaggtaagagtaatcacccttgccattgatcacttcagaggtccataccccatcttatggcctttactgcttttcctttaaaagtatcataatcatagaacctctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcaattgctgaattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaaagctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtattccttaacaccatgtgctaaaaaagagcagtttcacttaggaatgtccttcatgagcagtaaaaatttgttttattaaaacttgaacctttttaatattgtgtttgatgaaatagggattacccataaatctcttctgctgcgtagcagtgcaatggtcgacttgagaaaaaacccttgtgcagttgtttgaactgcaaacaccatttttatgtgaaagaatgattgacagacaaactatatttaatcagactttggtatttgggagatattttattcaaaaatgaacaaagtgaacctgtcacttcaagggaaaaaaattgacaatagatacgtttcaggttttaaagtaaaaaattagaattttggaaaatttgtatctcccatcataagcttgacagcttcctaatgcttaaagacttttctgaggagattggtggtgaaattaatgattgtgattatttgctgttttataatgaaatgtgtcagcatagctcagtgaaccaatatttttccaaatgaccagagcatatgtatatcacaaaattatgcatggataaaagatctattcgaaataaagtgtggaggccaggcgtggtggctcacggttgtgatcccagtattttgggaggccgaggcaggcggatcacttgagggcaggagttcgagactaggctagccaacatggtgaaattctgtctctactaaaaaaaaatacaaaaaaattagccgggcatggtggcatgtgcctgtaatcccagctactctagaggctgaggcagtagaattgcttgaactcaggaggcggaggttgcagtgagccaggattgtgccactgcactccagcttaggcaacagagtaagactctgtctcaaaaatcaaaaaacaaaaaaacaaaatagaatgtaaatgaatggattttaatacaatcaagtacaaaaagtttatcgatacggcttcagattctatattgcaactaacttttaagaaactacagtgtgtggactcagaaagaggaaaacaaccatttgtctagttttatttatttatcattatttttttgagacagggtcttactctgtcacccatactggagtgtagtgacgttatcttggctcactgcaacctccgcctcccaggctcaagcggttctcctgcctcagcctcccaagtagctgggattacaggcgtgcaccactaccacccggctaatttttgtatttttagtagagacggggtttcaccatgttggccaggctggtctcgaactcctgacctcaaatgatctacctgccttggcctcacaaaactgctgggattacaggcatgagccactgttcccgggctgtctagttttagtgtaacatcaagaatttctagttataacaaaaaaaaaaagaaaataaggaatatgtagttatatgaaaaagctattaaaatattatttccttttccgagttatatacgtgtatgaagctggattttcttcttatatttcaaaacaacattctacaaaaggttgaatgcaggaacttatgagaatctagctgtttttatttcaagtagatattaaagagagttgcaaaaaaataaaaaagcagtgtcaccatctcattaatttaaaaacagtacattttacctttaaaatgttatgaaatgggtttattcttattttaatggattaactttttaaaaatttctcagttttaattcctgacatggtaaaatatcaataggtatataacccacatgaacaaaaactctttgggatgtcagtaatttttaagagtatgaagggatcccgagaccaaaaaggtgagggctgcttccctaaccagacggggagcgcagatagaaatggcagcgtaggaaatgactctgtatcttctcttgctccaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagtaagtacatcaggctggcatagtaagtactctttgcttagcaggcaaagaggcaaaattgagtttgttaggtaggtacttacataacaagagagaagacaaatttccacaaattttttattgaggatattcaaaataaaataatagttaagtataatgttttgtaccacaggtatactattaagtgggattctttttgggggatgataacattttgcgtaattaggattcatagtatttttcatcatcagatttgttttatttatttattgttttgagatggagtcttgctccatcactcaggctggagtgcagtggcgcaatctcggcccactgcagcctctgcctcccgggttcaagggattctcctgcctcagcctcctgagtagctggtactgtatatgcacctgccatcactcctggctgacgccaagtgatccgcctgccttggccccccgaagtgttgggattacaggcatgagccaccatgcccggccaagattcatatagatgaacacttagttcatctataaaaaccacttttagctcatggattgtacaaaaatccagcattgggctagatttaacccacaggcggtagttgcctatctgtgatctgtctagtcactgaagggctgtttttgccaaagaataaatctggattgaaaacatcagtacaaacgaattggtaaaaattgtcataactcttttttttttttttttgagaccgagttttgctcttgttgcccaggctgcagcgcaatggcgtgatcttggctcactgcaacccccgactcccgggttcaagtgattatcctgcctctgtctcccgagtagctgggattacaggcatgcgccaccacgcccggctaattttgtatttttagtagagatggggtttctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactaaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactgtccagtggaaatacagtgtgaaccacatatgtaattttaaattttctaatagccattttgaaaaaatgaaaaggaacagatgaattaattttagtaatacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcgtgaaactaccgtaggtaccatgcatacaagtgaaacacatagtttgctttccaggacagaagttactggttcactggagatatggtggattctttgacctgagtccagcttcctttctgtgaataatttctacttctgtacccttttgtgtatataggaccattgtatataccctgtgaccagctatttcattcccttttttccccttattttccttgtggaaatacacctacatttgttttttctttcttctatgctagtagcaagatgtttagcagtattaaaaatgtataaggtactttgataaagcattgtggggaagatttattgctaacttcccataaagttacagttatcctatattgtaaagatacagcttacactttagaatctgacaagctcaacccttccaagctaatggtgctcctttaaatttatttcctgtggcttataggagaatggtaaatcatgaaataactagaacttaggaaaggtataaactccttttatatttgattactctcaaattttcatttgtctgaatatgtaatgttaaaaaaataatttcactaaaagggaatcaggacatcttggaggatgactgattctaggtctggaattagaaatgtacaaaatgagcctggatggggcatcttgtcataaaggaaagtatggaaaataccaggtcatatcacaaggattcaggagctcagttcccactggtcaagactggaagaatatgaactttaaaaagcgtaactgaagtgctttgaaactgtagtagatggatatgaagaattattgttccttttgccctgtcgcactcctgaaagcaagatgattcaccagcagctctactggagccacccgcgaaaagtcagccagggttcttgctattgtgtctgctgaaactgggcacagtctgatctggaaattgagcctcgttacatgccaccagtgtttccatcatacgtgaaggatatagatttcattaagttggactaagtgatcttccacgaatggattatctaaggcacccacccaatgagagaaaccatgttacctttttgtacataaaataaatattttaaaataattattgttattttttatttttatttttgagatggggtctctctctgttcctcaggctggtgtgcagtggcatgttcgtggctcactgcagcctccgcatcccaggctcaagtgatcctcccacctcagcttcctgagtagctgggaccacaggcgcacaccaccatgcctggctaatttttaaaattatttatagagacgaggtctcactatgttgcccaggctggtctcacactcctaggctcaagcagtcctcccaccatggcctcgcaaagtgcttggattacagacgtgagccactgggcctggcttttttgtttttgtttttgtgtgtttttttgaatgtgataaaggtagtggaaaaaaaaaaagacacttgcctgtgcgtggtggctcacatctgtaatcccagaactttgggaggccaaggcaggtggatcacctgaggtcaggagttcgggactagcctggctaacatggtgaaaccccatctctactaaaaatataaaaattagccgggagtggtggcgcacgcctgtaatctcagctacttaggaggctgacacattagaattgcttgaactggggaggcagtggttgcaggaagcaaagatggtgccactgaactccagcctgggcgacagagtgagactctgtctcaaaaagaaaaaaaaggattcttaagatacacattaaaatattatagatgaagctgggcacagtggcttatgcatgtaatcccagcactaggattaacattttttcataataaaaagctttttctaaaactatagagaccttgttgagaacagcactacaatttttttcttgttttttttggatggggacaaggtctcactctgtcatccaggctagagtgcagtgacgtgatcatggctcactgcagtctcgacctcctgcttcagccttctgagtagctaagactacaggtgtgcaccaccacacctagctttttaaaacaaatttttgtagagaggatctcgccatgttgtccaggctggccttgaacacctggtctcaagtgaatccttacaccccagcctcccaaagttctgagattgcatacctgagccaccatgtctggcctacagtttcttttcttttcttttctcttttcttttcttttttttttcctttttttttttagacacaggagtctcgctcttgttgcccaggctggagtgcaatggtgtgatctcagctcaccgcaaactctgcctcccaggttcaaacgattctcctgtctcagcctcctgagtagctgggattacagacatgcaccaccatgcctggctaattttttgtatttttagtagagacggggtttctccatgttggtcaggctagtctcaaactcccgacctcaggtgatccgcctgccttggcctcccagagtgctgggattataggcgtgagccaccgtgcccagccagtttctttagtaattcatttctgtgacagttaccactgtggggacatttgttcttgcatcaaatcactgttagttaaggctattcatgttctgtccaacagcttggcaccaacacctgcttactttccttttctcttttaccctctcttctcagttctctctttccagacgtagtgaactgtatgcagactgacaatctggaactaaagaagcttgtgtatctctacttgatgaactacgccaagagtcagccagacatggccatcatggctgtaaacagctttgtgaaggtaacttttcccaaggcctcaataacagagtttgaattgcaaataagtaacctctgttcacaaggaaggagtgtagggaagtgttggcaatgactaggaatgttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtggcacgatcttggctcactgcaacctctgcctcccaggttcaagtgattctcctgcctcagtctcccaagtagctgggattacaggtgaccgtcaccatgcccagcttatttttgtatttttagtagagacagggtttcaccatgttggtcaggctgatctcgtgctcctaacttcaagtgatccacccacctcagcctcacaaagtgctggggttacggacacaagccaccactcccggcgtgattaattttttttaatggaaaattttaaacatattcaagaaaaaggactagtataataaattcctaaatatccgtcttgcagttttaacagttaccgacacataaccactcttgtttgtaatcctcatacatattttctgacctccaaccccctctcctgctggataattttaaagaaatcctgaacatcatatattaaatagttttgtctttatatttgtcaagataagatcttttatttaaacataaccacaatatcatcatgtctttaaaaatggacaaaatattttcttattattgaatatccagtcaaatctttcctatcatagatttaaagaaaataataatgggatcattcccattaatttttttttttttttggtgacagaatttcactcttgttgcccgggctggagtgcaatggcgcaatctcagctcaccacaacctccgcctcccgggctcaagtgattctcctgcctcatcctcccgagtagctgggattacaggcatgcaccaccacacctggctaattttgtatatttagtagagatggggtttcaccatattggccaggctggtctcgaactcctgacctcaggtgatccgcccaccttggcctctcaaagtgctgggattacaggcgtgagccaccatgtccagcctaatatttttttaatagttgttttttctctgtttggaacttagtgtacatttaaaaaaaacagacagcatttctaaaattagcttctatttaaaatgttttgaaaaataagcaatatgctttcttctttctcatgaactttttgttcttttcctgtgtttagctacattatagagtcagaacgtaacagtttgttctccatgactggtggttcatagagggaatatatcattgggaagaatttagtttacattttttggaagttagagttgtgcatagatttacatgggcttaaagacatttttttagtgtaaggcagtttaaaagagtgttctttctccatattctatttactatatttggaagcacttgctagtaaaagagaatgtatgttagccaagagctcagagggccttctctgctgcttaactccaggtacttatttcaagcccagaccagctcctgtgctcccctttgttttcttggctgcaggccacagaaatctagctctcttttctatttgatgtttaggaactcactgtggagtagggcacggtctttacagctcctcttttttttttttttttttttcctgtgccggaatacaagcccaaaagcttttcctgtttttagggtagatcctaatggctgtgggatggtacgaactccctaaacctctgcctggcactggagtgaatcctgctgagctgtttctcattttgtatttaaaacagttaaatgacttcttcacctaaactcttaaatagggcagctaagatttgtacttaggaaaggaatagcatggaagattggagctcatgtagaatgtatctggaagcttaaattaatgaggtaattcttttgcagcttacataaactggactgtttacttttagccaccatgtatacctacagttgttggtgattgttttctgcaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactttgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaatttctagggcaagattatttttagccaacttggttatgttgtaaatgtttagcagccagaacatagcttaacaccttaaagttttgggaccttttccttattgacattttaaactttgcttatataatgaagaaggtcaagtcccaagtgatatgtttgactccagtaataactaaagctcatttgaattgggtactaattgaatatattggatgggtcattaaatattgttgccaggaagatggaggaaaatagccactttctttaaagtgctacctttttggtctaatgcaatgtttactgaaaggtgcataacactaagagttaatcagtggataacctttgaatattcccttttaaaaattatttatctatctatttatttattttttacagataggatcttgctctgtggccaagctggagtgcagtggtgcagtcatagctcactgtaactttgaactcctgggttcaagcactcctacctcagcctcctgagcatctaggactgcaggcacatgccaccacatcccgctaatttttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccaccgcacccagccttattttttatggagatggggtcttgctatgttgcccaggttggtcatgaattcctggcctcaagcaatcctcccaccttggccttcctcagtgaattactgtgcttggcctgaatattttcttagtgaactttaaatggagaattagaatttggctggacatagatgctgtctctcatttgtaaattacctgttcacttctctgctttgacattttgtttggttcattttattttacaggtagccttggcttctgtttattatccttcaagattagtattaaatccacaggatgaagcaagtcataattttttaaggtttttatggtagtaactaccattagaaatctttcaacctaggcataagggtgggcgtcggtgtgggtgtggaagtgcagatgctttaaccatgacttctgacagagcatcaccaccagtactagaagattcaaccctgccttttatttcccctaagtaacaccatatggtaccttttatttattttttattttttatttttttttgagatggagtgtcactctgtcgcccagtctggagtgcagtggcatgatctcggctcactggaacctctaccttctgggttcaagcgattctcctcctgcctcagcctccttagtaactgggattacaggtgcccactaccatgcccggctaatttttgtatttttagtagagacgacgttgcaccatgttggccaggctggtctcaaactcttgactcaggtgatgcacctgccttgacctcccaaagtgctgggattacaggcatgagccatcacacccagccccctttttaaaaattacataaagaaattagttggctaggcatgttggctcatatgcctataatcctagcactttgggaggctgaggcagaaggatcacttgaagccaagagtttgagaccagcctgggcaacaaactgagaccctgtctctacaaaaatttttttaaaaaattcggtggggccgggtgcagtggctcatgcctgtaatcccagcactttgggaggccgaggtgggtggatcacgaagtcaggaaatcaggaccatcctggctaacgcggtgaatccccgtctctactaaaaatacaaaaaattagccgggcgtggtggcaggcgcctatcgtcccagctactcaggaggccgaggcaggagaatggtgtgaacccaggaggcggagcttgcagtgagctgaggtcgtgccactgcattccagcctgggtgacggagcgagactcttgtctcaaaaaaaaaaaaaaaaaaattttgttggacgtggtggtgcatgcctgtaattccaggtacttgggaggccgaggtgggagaatcccttgagcccaggagtttaaggctgtagtgagctatgattgcaccactgcattatagcctgagtgacaaagacagacccttcctcaaaaatatagaaaaataaatattgtctaaagttagtagtatctactttacagaatgtttagctggcaccaacttgtgtttttggcattgcttttgattcactgttattctgagcaactatctataattctctacctgaggacagatgagatgaaaagtgtttgtgctgcaaccgtcaaccaggtgggcagaatatcatgtaccccgtggaaacttattaaatattcagtggtgctaagaatatggaatggctcaaagggaaaatgagttctaacttacaggcgactccagtttgaggcagcatctctatgctaatgtaaattctttaatgcagaacctatacagttagatggtcagggataaggcctaagggatgtttagcagtaaagtcgtgtgtgtgtgtgtgtgcgcgcgcgcacgtgcgcacacacactcaagtagcacatttagagatctttatccagataaaccgagaagaataaaatgattctggaacaagcttagtttgtccgatttattcaaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattatagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgtttgacttagcctaaagaggtgcctggagtgtaaaatttaagaagacactcattctcaggtgcgaactctgtacctcacaagcctgagaacagagtgcctccttagttttgtgcctggagtgcctcacttgccttactcttgtcctggccttgttacacatactcatattaaaatcattttttgagctcttcattcttgttttagtgaagaactgaaaagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcacacacacacacacacacacacacacacagaactgcttcattttctcaaagtgtttacgtttgaatacataaagactgagttatctgaacactgcttcattatagaaatctcaaaaaagaaaaaaaaaatgaaagatacaaaaaaaaaagaaatatcaatcctcttattccagtgatggatatgagtccttattttactgctcttgaggagtgattttgttccactttttcagaggctactccacatggtggcagcactgcaccagcacatattagattctcttagaaaagaaaagaatgaatgcttccaggggttgtgccttagtagttttcttgtagctcacttcagaagggcatcctagatttgaaagcactagaatatctgcagaaatgactttgaaatcttctaatatgagagataaatgttggtcgagggctgaaaattcttggtgttatattgacctcaagtctggttcctagtgacactgtgccttgctgcaggtaacaaagctttaccatagttttgtttcctgtgttttgcagagaatcacatacatcttactttcctgcagttgttttacaatttatagtttagttgaagctaacttttgatgaaatactagttaagagagaaaagatgaatttagaagtaaaaaaatctcactctattaagtcctagctttatgttcatgttgtttaacttacccaagtctgtttcctttcctggaagatgaaggctactatcttagagagttgtttggattattaattgagcttttgcatgaaaagtgccctgtaaagtgcttggcttatgggagctcataagtggtggctgctactgtaattatgaagtaggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatatcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcatatgctaccatgcccagctaatttattttattttattttttgtagagatggatcttgttttgttgcccaggttggtctcaatctcctagcttaaagcaggcctccagcctcagcctctcaaagtactgagattataggcgtgagccaccatgcctggcctgctttttgtcttcttgggttcagtcctcgtaagtccctttggtttactgcctagcccctttgatcttcatcttccagactgtctatcactctcacagctgcccatgagaatacctgtgcttcattgttctgtcctctctgcaaaattgcaaactgttgaattagtaaaaaaaaaaaaaaaaaaaaaaaaatttctcatttgttaagtgttcttctgcataagcagcatgctctcagaatagcctcaattcaggccaaatataatctttaccaaaagttgtagttaaacttccagcttcttttaatttgaacttttgcttgaaaaccattttatgaaaaataacatttttcttctcagaaagcagtatgtattttgactatgtgctagccagcacgtagacacagcatgggattatgatggtggttctcaaccaggagtgattctactctccaggggacatttggcaatgtctagtaacatttttttggttgtcaaacctgatgggaggagtgctactggcatatatcgggtagagtccagggatgttttcaacatccttcagtgtacaggacagtcccccgacaacaaagaattatccagcagtaaatgttaataatgccaaggttgtgaaaccctggattatggaaatagcactgaggcttcagagccagagtggctgctgtttgagtcctggcttggctgcttactagaaatgtggctttgaacaagttatttaaaatgaacttcagttgtcttatatgtaaaactgaggtaataatgccgattttagtgaattattttgaagatgaaagaataatgtatttaaaattttaaactttgcctgatatatggtaaatgcttaataaactgcagctattcttgaggaagtggcctaacattatgcaccttccggttgttataatcttcatttaggcattaggaagtttacttgtgtggtgatttgttgtcaacctaagatgataaaatattgaaaaaatgccatctgtctagatctctttctaagaattttcgtcagaatatatttggtattcatgtaggctatgttaaactgcctattaaaggtaggcccagaatgcatagaaaaacttaatgacttaactttatttagtacgttaattataggattgttgttatccttaaatatatattagtaagtaacaattacaaaattaaaatattatacataaatgaaatttaaaatgtgtaatacttttcatatcaaatgtccatgaaggagttagagctggcagaattttaggcacatatgataatgtcagtatgtggtgagcacttgataagagtaacattgaaggtaatacattcagtctgtatctgagttcctcaaattgtgtttcatattataaaaggagctgctgttaatttttgcaggattgaagtttgggtaagtggaatcattgggggctgctttgatatgaggccaacttcccagctcttgaatttcccaccagttggtctgagtgtatttctgtctctacttatagagaaagcaaacactttttgttttccttttataatgtgctttgtggaaatcattttctgtgtattttcacttttaaaaaatcattacgtcgttttatattattatgaacttaggttttaaaaaatatctcttttttttttttttttttttttttttttggagacggagtctcgctcagtcgcccaggctggagtgcagtggcgcgatctcggctcactgcaagctccgcctcccgggttcatgccattctcatgcctcacacttctgagtagctgggactacaggcgcccaccactacgcctggctaattttttttgtatttttagtagagacggggggtttcaccgtgttagtcaggatggtctcaatctcctgacctcgtgatccgcccgcctcggcctcccaaagtgctgggattacaggcatgagccaccgcgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcacaatctcggctcactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaagaattttaaagattaaattttttaaagctctgagggcaacttacccacaaatgaagctaaatctaagagaactacttactacttttacaaggtaattattcaagggtgtacgtttaaagtagttctcaacagcaacttcctgaaagctggatctgttgtgtgttgttttggtggtttgccagtatatcaaggctcatttgtcactttaagatgacctcaaggctgtaatttggctggggaatactttactctcagaaatggggagatcataagtggtgtgataataagtgttttattttgttcaagttgcagcttgctttaatgaattttaggggccatggtccaaataactgtgatggttataggcatgccttttatttgtttatcgatatttatttgtagtgttttggctttgagagtacttgaattttgttaaatcatatcttaaaccacttaagtaatgaattttattttttgtaaaccttgttactatgtaatcagactttcttttcataatgagatgtgttggctcactaggtagttttacctctcattctaaggaagaagatggggaaaaaatggaatattctagattgtaatgtagcaggcatattaacagttggcattctagacagtgttttggattaaagtataagccctaagttttacttgtttgactggtactgcagtcattgtctccttaaggagataataatgactgaaactctcagaacaaatatgttgtcctatgcctcacatgtcatttgaggtcattctgtaaaggagatagcaatattctaacactgctaatttagaagagaacaaaaatatgtaaaccacctgtgtatttcctcataatagttttggtcagttactctacttctttcactttattcaagtcttcagggataccagccaaaataattgtaaattgagcagaaaaactgaagcataaatctgttcatagtgtgtgaccttgaaggtcattgctggaaatcaaagtcctgtaaatagtaatttacttaacaggaagaagtcactgaactggaaagtggtaagtttctaaggttccaaggccacgaaaatgagtgaaattagagtgcaaggtgaaaatcattttaagggacagggaaatgggtgagagattcctcataagtgagcttatgtgtgtgatattccactcccagtttatatctagatttcctttgagagtccttttttttacagggtcatttttattctaaccatacctactgtaccagctcactccttttttaacaaaatgaggtcaaatttattatcctcaactgctgcatataagacaggtatagatcataaatcatattttatagctaggtagtaaatctttccctccctaagtactgtaggatatgattatctctgaaatgtataaagtagaatacatttttctccttgtatataaatctacatgtcacctttgctggaaataatgtttggattatattatcctcccctactctgaatcttctttcccttcccttggttgaagttcacaagtcttggaagctctataaatgctggagaccaagtattagtactcagacactggaatcagatgcagaccttgagttcagattcaagcaggaatccctttctggctgtgttgaccctaagcaagtcactgaacttctctaagtcagttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaatattagcactttgggaggccaaggcaggaagattgcctgaggccaggagtttgagagaagcctgggcaacatagtgagaccctgtttctatttaaaaaaaaaaacaaaaacaaccagcagattccacaggtccataaggaaatatcatattgaagagaagtctgtaattaaggcagagaaagatttgtctaggattgagtatgattttacacatctacatgtgctgcttttatatatatgtttgtgtttaatatctatctctgtaaagtatacataattgggttagctctttgaggggatgtgaggggtggggaatgtttagtttcagtctccccaagaatagaatttaccataattgggaggcaagatgaataaaggattttttttagttttttattttacttttatctttttggagacagagtctcattctgttgtccaggctagagtgcaatggtgtgatcttggcttaccgcaacctctgcctcgcatgttcaagtgattctcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaaagtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgacgggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcctggctactcaggaggctgaggtggaaggatcacttgagtccaggagtttgagattacagtgagctgtgatcagtgcgactgcattccagcctgggcaacagagtgagaccctgcctctttaaaaaaatacaatttttttcttggaaactctaatttttctgaaatggtagctaaaggccattgttctctttctgtcagtatttcctaagagaaatgccaattttttgacaggagaagtgttacacatagttgtgttaacagttctaaatcaaagtaatagttcaaatgaaagaagcacacctttgtcttagtatacaggtgagtcaaggcagttattgtaagggttggatttgttcttttgtgatattattgtctagagaagactctggaggaagaggaagtaaatcttgagtttcaatctattattttaaaagtttattttaaaaacggaacaatatatattcatagtacagaattccaaagaaacagtataaacattgacaagtgagttgtcatgtactctctagccacccagttgctgtctcaaagttagtctttttctttaagatactttagattcagtgcgactgatttattttaagttttcattgaagagtgagagaaactcggcttacggaccaggaaaactgagagtgctgcctggtgagcctgcctcagtatgttgctaaaaatgtaacagtctgactgtggagattaggagatgaaagtgtagagataggatggaaggaacttcaagaaattttagagaaacattagagttttggtatagaggggtaggatagcatctcctctggacggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagttgcctataataacagaggatttctaattgctcattctgtttagcattcttctggtctttttctccccattgctgtttttaattctcccccttctctcgttttctttgtctatatttcctattactagaccttatatttaatctttttgtttttttaaacatgaaaagggtttcactgacagaagtggtaatttatttcagacaactggtaaccaagactgggcatgtgttggcaacaataaatcaaaacaggcatttggccttctgatatgatattttgattctttagactataataaggtcaactaagtatgttgtgcaagggaaataaaatatcttgcatgtgaagcacatggaagggattattatttctctctttatggcttttctcatgcttgatgatagagttagcaaacaaaaattaagtcagaaaagagcctcatacatgttaccatccagtaggtgggctagataagttttcctgatttgtcttaacaagtataaaatagtatatctgtaaccatatttaccaagtgagtctctgatttttcatcttagcatctttgttctgatcaccaaagtatagcttgagatgattgcatttgtggcatcattatcctttacataataatggacatttttgtaagtatattatttgttaaataaatcacattctctagacatttatcttctagataaaatcatatgctgggataatctgaagattacacagatgatgtgaatactaaaatcaatagctagattgtagtcattatgtttcttcccttgctaacaaaatgataatcatacaaatcttaatttctctagtttttattaagggacttcagtaagaactaacaatggttttacatttttgagaatatttccaatatatataattgctgaagcttgtctcctatcacatctcatttatacttggagaatatttatttatttatttttgagacggagtctcactctgtcgcccaagctggagtgcagtggcgtgatcttggctcactgcaaccttcacctcccgggttcaagcagttctcctgcctcagcctcctgagtagctgggattacaggcacacaccaccatgcccggctaattttttatatttttagtagagacagggtttcaccatgttggccaggctggtctcgaactcctgacctaagtgatccgcccatctcagcctcccaaagtgttgggtttacaggcgtgagccaccacgcccagccaacttatacttggagagtatttatattcagcctcactttgctaatctttcatcagcatctgggaacctcactgcaaaacatggtcttaatttacttgtacaaagccacaatatatagtatttgtatgtatgcatttttttttttttttagtatttttgcaacttttaaatgactttagatgttcttcctttgtagatttcttaaaattaatttgtaattttgataaagtgttgacttttcttcctgcagctaaatggattcccagatctgtgagtcaggatacaagtgtactttctagtataaggtagcaatttttcagccgggcatggtggctcacacctgtaatcccaacactttgggaggctgaggcaggcagatcacctgaggtcaggggttcgagaccagcctggccaacatggcaaaaccccatttctactaaaaatacaaaaattagctgggcatggtggcatgcacctgtagtcccagctacttgggagactgaggtgggaaaatcccttgaacccagtagatgaaggttacagtgagccaagatgtgtgcctactcagaaagaaggatacatttgaaatactgtatttcattgaatctttaatgccactgattataagatgtattattattttctgtattactaagaaagaaaaatgcttcctattgaactgacaggccattgattataaaatgcaacccagtttcaaaggtgttaatgtgaaaaactgtagcttacagttgatgaattatggtaatataaccagccaccttaaatttacataaggctttgtagaaagcacttacacatatgtcatctgatcttatccttaaactaaaactaatctgtgaggtggattaaattatctcgttttcagatgaagaaactgaacttcacagagattacatattctctcagcattgtatactagtgaactagggtctcaggcccacatattctcactctaagacttgtagtatgattaatggtgtcacctcccccaaacccatacatatacagctacacaactataagattatttggcctagatttttctctctgttgcctaatgtacatatttcatattcagactttgtcatttttcatatgctgttcatatgtcttgattttgaaagttttgagtgctgttaacatggttaatgtatgttttcctattaaataacatgtgactctgctaatatatgaattgttttaattctgggttgccttaccactctatataatatcattggtggtttaatatatgttttgaagtgatttatttgtttctatctgactaggtaaaatgttcaggaatggttatgaattgagatccgtgaaatgacccagagaaggctgatgaagtgtttgtctatagctgtgctgttcttggtgaatcaaggtcatacccccttcttttccaggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagaggtcagtctgttttcctggctactttctggtagtcttgcctgatgcagtaagttctggagtctgctattagaataaatctgttgaggaaggtcagtggcttctggggtagatattgctatctccagggtattttctctctggatttaggaatattttaggtggtagaataaactatgcaaaactatttctaagaaatgtatgtttttcatacagttacttctgctaaaatctcttttatcgtcttacgtctcccatgcacagttcttggccatttggccagcaaagattattgagtatctctctttggggtgacagatttttcattctattagatatatagaaagtggcttcatattagttattgagctgacctgtatatataattcagtatgagagagagtatgttaaagtcagcagaatatatcctcctttccagtagatatggaaaccatgtcagtctgaatttgaagattttagaaggcacacctagattgttctgctcagcctgttaccatgtaatgttgcaaattttctttggttattagaaattgactactaaatttcatctacacatacatacattttagtttacaaagttggaattatccctaatttttattgagcattttgtatatgcaggcactgtactaggcaaagtacttctgaagaaatgttggctcttcattaaagttggtatattttaattatggtatttaagaactggtctggctgaagctgatttccaagctactagaatgtaagtgatcttcacttatctgggaaattgtccctctagactgaactaaagctcactctgatagtttctttccatcactgaaagtacaaatatagtctggaaataactttactgagaattttattttcttctgttggccattgacatcacattcattcattcactcacttagcaaatatttattaagtgcatactgtgtgccaggcagtgttccaggctctgaggatacagcagtgaacaaagtcatggccctctgggatcacttattctgaaggatgggggtaggaatatatataatatgtatagataatataatatataatatgtatagatagtgtaatatgtaatatgtgagatggtgataagtactaacaagaaagtaaagtagagaagaaatctaagaaatgctgggcatttgggggtgaggggttgtattttctttttaaaggatggccagggaagacctcactgagaaggtggcattcatataaagacccaaaggaagtcaggaataggaggaagagagaagtacagcctatttatcttctttctttaatacagtaagttagctacttgtgttgcccaagctaccaaaattggattaatttctaaagaaccctcaacagataattaaatatcaaccattttatgaggcatgtaagtgtaggtggcaggggctaggagaggggggagacaggaaaatatagtagtggtgtcctgctatttaaaaaacaaacccttttcagagagtcccttattctcattatccttaagagaggaggttggattgttttccctaccagcctgcctcctgctgtatcttacaatgaaatcttcagccacaactgcgtttgctgtctcttcctatgaaataactctcagaatgcttaatttgacttcctataggttgagtagaaatgggctgagaggcagggagccttaacataatatggggagacaaagaggactataaaacaagaaggtaaatggtgtgagctcaagtgtcttgggtattgctaggttctttccagtttgaacatcccttattactggtttcctgaagtcttcttatgtccctgctctgcctgtagtttgctgagaatgaggcttctgcattgttggatcccaattttacctaagcatggagctttgacttttctaactaattctttaattttttgatacttggccattagactctgacatattaccttatagaatgaattcagcaaataaattataattcatgatattaattttcattctccaccctcagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggttgggaaatagcgaagtgttgattaaagtgtttgtaattttgcattaagcttaataatgtcaatgttaattaggctagtgttaatctctttttaatatatggaaatgaaaatgttatatggcagaaaaacttgcttgcctagcaccaggaggctaacagttgatattacagtgtttctataataaatgccatgcgttgctccacaatccagtttgttttctgaagggtctctttctgatatactgtctagtgcctggttgatatggttcaggctgtagtttagagccagattgttgttctagcagttcttcatggcaacatgtgccctgatgcttaaaaaggataaaaataatctgccaagtggaactgataagaatagaggcgtatagaggaagtttatgcttttttttttttttttttttttttttgcctgagtggagcgagaggagagcagagaggcacagattaggtattaatacagtctcagaagggtatatcagtatatgccttcaccttcctttcttctgtttctgtgtaccctaggcctgaaatcttgaagcaggaaatcaaagtcttctttgtgaagtacaatgatcccatctatgttaaactagagaagttggacatcatgattcgtttggcatctcaagccaacattgctcaggtcagactttatgcagactcaagttgatgatgatttagctcttaaggtctggcctttaaagaagctaggctgtgagattgctatttgagaatccttaatgattaaccacttcctgggtttaacaggttctggcagaactgaaagaatatgctacagaggtggatgttgactttgttcgaaaagctgtgcgggccattggacggtgtgccatcaaggtggaggcaagtgtctgatggtagttaggatcatgtattggggattctgagagttctcttcacttttttctttaaaataatttttaagtttatcaaaataataaagcacacagtttcaatgttaaagaatttttaatggaaagcagctgtctctggttcctcccttccctacctagactttcttctcagagggaatatttttaactctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttggtatccacaggggcccaggaaccaatctcccatggatttggagacatgactgggctgccatatctctaaataatattcttggctgggtgcagtggctcacacctgtaatcccagcactttgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgagtctgggaggctgagactgtagtaagctgttattgtgccactgcactccaacctgaaaccttttcactctgggtgacagagcaagacgctgtctcaaaaaaagaacaacaataatattcttatgctattatttattaatttacctatcatagactttttctgttaactatctgctataagaagtttacttcatacacccaccattcccacttctgtctcctgttttccagtgtagttacataatgaaggtttttgttcctatatccattatcatggtagattgaaataatatgcctttgtttcttattctatcaactgttggcttgcaaaatttatgcatattacgactgtgtaaatatttagggccaatgtaatgcaaatgattacattttctttcttatagcatcttttttttttctggaggttttttgttttgttttgatttttgagacagagtctctgttgcccaggctggagtgcagtggtatgatctcggctcactgcaacctctgcctcccgggctcaagcgactcttatgcctcagcctcctgagtagctgggattacaggcatacgctaccacacctagctaatttttgtatttttagtagagacgaggttcgccatgttggctgggctggtcttgaactcctagcctcaagtgatccgcctgcctcagcctcccaaagtgttgagattataggtgtgagttaccacacctggccctggagtttctttaattgcctctttttttcttgcatgtgtgtctttatcatgcccctatattattcctgttccttaagcataatatcaaatctgtaaactttcttttgtcttagacccttctcttttgcagtcctctgtcttcttgttttttctactctgactgattgcttttctggcttctgcacatcattccatacagcctccctatttcttgttattggtatatttttccttgcattgctctttttgtggttgcaatagcttcttgaatctctgaggatatgaatgattcgtttttttgtttctgcactttgaatttaattatcggatattttttggtgatgattgcatatctatacatataattttttaattgagatgtataccatgcatacagtaaagtgcagctcgtttctgtttaagaaagaggtaacagaaaagttgattaggacttctgtatacataggcaaggctgtcgactatcaggtttctgctttagggaagggggtttatctttacatggaagacctcttgaagagcctatctggtcttagagggcagattggtttctagcttggctgcagccttccggtaagtattatgggctgtaatttatattgccctgcttcatcagtcagcagtcctccatttgtttgtcctcattcagaaatttgttgaaattaacagtggcttctgttcactgtttttatgggttcagagccccatgtttgttcttgctacttgattatatgcagttctgcctagagtcagaggattggaccatatgatttctcaggaatacgaaaacaatttgtacagtatgaccagtactttaccggaacaaaaggaggcagatgtgtgtcagagaatcttctatgaaatacctgttcctaattggccttccttgttttttttcagtttagtgctgcttcatgtagtttctgttgataaataatttaatagaaaggctgttaacagcaagaagttagctagtcctgggttctattcctggttctgctagctcacttgattcagatatttaatgtttctcttcattggagaaatgttaaagtctttttgttggatcttgatatgttaacattgtttttattaccactgtcaccacacgtcacaacttgtttttcttttctttttacgttaacatatcttactagccgtctacttagtattaatgtagataattttcagagagattttggtagcataagagtaaggtggttttgttctcttcactagtgtacatagccatcttttccacaagactgccattgtcttatgacctacctctctgacaaagctgtaaacagtaatacaaaaattatatcttattctgaagttcagagactttctagccctggaattactagaaagtgttctcaaagcatctagattcctcaaggctgttagtcatctattgtgactaatggaaaggttctccataatcttctggaaaagacttctgatggctttcacttcttcctttgactaagcgtgctttgatgggagtatgacaggatgtgaggaatgaactttcccaggaaacttaaggtcacccttcaggaatcctgtcttatctagtgctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaaacaaactcctggtccttttcagttttaaaaaggagagaggttgaggcactaggttaagaccaggagttcttcacttcctggtcttctggttattttctgtttactatttctgatttttatatattagaataaaatattggtttgtgtgtcatttcttaaagacaaaaaacatatttttcctattaggaaaaccatatttgtttactatatataattatagaacaagttaaacaaaaaatggggtaccccgcttcccccatcttctgtttcactctctcagatatgcagtggacataatctggtagacatcattttatatcattgtttatatagtgttctatacaaagatgtatttttttataaaaatgaaatcattccacaaatgctatttatttactttgttttatcctctacttttttttttcttactagtaatatcatggacattgatccacattataaagaaaaatttatgtcatctttagtttctggtttatagacataacgtgattacttgataacttactgaatttgtaactttatcccttattataggaccttaaagttgtttctactctttttccaaatggtggtataaggagtatccttgcaactaaatctttgaactctagttgaagtgaacattttttcataacagttatgcttattagccatttgggaattgctcactcatgtcctctgcacctttttccaatatgttatcttttccacattgttgttttaaagtcttttgtaattgagatgttaacccttcttttagttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactatttttttttttttttacttctatggcaatgattttgttttatttgttttttggggggtggtggggaaatggagtcttgacttgtcgcccaggctggagtgcaaatggcgcaatctcagctcactgcaacctctgcctcctgggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtgtaagccactgcacccagcccttgttttatagtttaagggtaattttaatcaaccgggaaataattttagtgaaagatatgagtagagtggatcaaacaccagaacaaattgttctttccttactgttatgaaatgttgtctttatcatatactgaattttgtatgtatttctgtttctggactttttgtatatacaatgatgggatgtttacttctgttcctctgccatactgctttaatggtagttttttttttttaatcaaaagcagtatggttgagatgataattttctttgaaaattaatatccctgacataaatgtttttcaaatgtttatacatcatgagtaacatccttttatttgtattcattttaatgataatactacggatttactaaatatgagctttatatcaagcactgtgctaagcacttacttgtattattaatttatggtaattcaatgcttacagtggcccatattctacatactacataatttattaatataacaattataatattaataaatatagcatatttaaatttttccaactgttttgctgttgcaataacagcaaaggaattaatagctgaaaatgaataaaatagaggacataaatagaatcagaagaaggacagaactacataaaagactgcagaatcggccgggcgcggtggctcatgcctctaatcccagcgctttgggaggccgagttgggcggatcatgaggtcaggagatcgagacatcctggtcaacatggtgaaaccctgtctgtactaaaaatacaaaaattagctgggcttggtggcccatacttgtaatcccagctactcaggaggctgaggcaggagaatcacttgaaccagggagtgggaggttgcaatgagcatagattgcgccactgcactcagcctggtcacagagcgagactgtgtctcaaaaaaaaaaaaaaacagactgcagaatcatttcatggtacaacagaaccatcctatatatgacctcatataaatgatctcaaggtacagttttgtttttattaaattgcttatagtggtttagattgttatagtacttctaaagatcttattacagaaattttcaggtgtacaataaagtaaaactgaataatgagatcttgtgtagtcatcatccatcttgagcaaatactgatatgttaactgtttccgttttatcttctccctcttcctcttccttcgggtgggtgggatgcgaatacaaatcccatatatcatcttactcaagtagtccagtgtgtatatctaagagataagatactttaaaaaatatattgtcacattaccatgcccagcaactaacaataattcttaattttattgaatattcagtacatgttcaattgtccctaattatgtaaaaatgtctttttacagtttgtgcaaatgaaaatctaaatatggtctgggccaggcgctgtggctcacacctgtaatactagcactttgggaggccgaggcgggcggatcacttgaggccaggagttcgagaccagcctggccaacacggtgaaaccccgtctctactaaaaataaaaaaattagccgggcatggtggcgcacgcctgtaatcccagctactcgggaggctgaggcaggagaaatgcttgaacccaggagacaaaggttgcagtgagccaagatcatgccactgcattccagcctgggcaacagagtaagactctgtctcaggtctgcacattgcatttgaataatgtgtctcttaagtctttttacttacttattttggtgccaggtattgaagaaactaggtcattaggcttatagaatttcccacagtctggatttggctgttgtatcttagtgatgcagttttatctattcctccatcctctttagataattaaatctagaggcttggtaattttcttgttcagaatttttagcaagaatacctattgggtgattctctgtacttcctgttgcatcttatcaggaggcacataatggagtgacccattatagtacattgtaatatatgataggctggtccttgacttttaggatctctgttctggtatctctctcttttaaaaatgatcacttatagtttctgtacatttgttttttcacctgtattctctcatattctcttcattaataaaagattaacagataaaactccattttatagattaattataggctatggaaaattgttgtttatctaatgccatagacttttaagtttcatagccccaatattggtaaattgtcgagtactacagttctttggagtgttttggatcatgtgtaactttgaaaatgtaatggaagttgtagacccactcactggaaaatatgcttgaaagctcctacaaaatttggcgatttcatttcagtaggtttaaagacaccctctgctatctccactcatccatgaacttcagttaaagacctcctactttggcttattctttaattcttattctttcctcctacgatggcttattcttcttacttctatctcctggctatccaagatgggtgtgtgtgtttctctgtttctggactttttgtatatacagtgattggatgtcactctacttctctgccatactgctgtaatggtaggtttttttggtgggggtgggggcatagtctcgctctgtcggccaggctgtagtgcagtggcacgatctcggctcactgcaacctgtgtgtctcccgggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtgtgatctcggctaactacaacctctgcctcctggattcaagcaattctctgcgtcagcctccggagtagctgggattacaggtgcctgccaccacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattacaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatcaaaagcagtacggttgagatgagaattttctttgaaaattaatatccctgacataaatgtttttcagatgtttatacatcatgaggaacatccttttgtttgtattcaaaggattcatttgaactgattcacctatcagttcaaataataaataaaactgtatcatatagcttggtatctagcctgtagtacagcttggtcaaattaagtgcctgatcatttagtttggtttagttgatgcacctgcatgtttcaaaatttttatgttgaggtggtgttatcgcatagatcatctgacttctcattttttgtatttttcttcccagcaatctgcagagcgctgtgtaagcacattgcttgatctaatccagaccaaagtgaattatgtggtccaagaagcaattgttgtcatcagggacatcttccgcaaataccccaacaagtatgtccaaatacctttacccctctttctcaaattacttaggaaatgtttaaggcactttgaaattgcctaggtaagaattactcttttgaatgttcctggtcataataggatactttatcaaaaatcggaaacataaaatggttagcacagggattaaaacctgagttttcactctgctttctttctttaggaagaattgaagctctgcctgaatatgcattgtctattggcatattttaaagttaaccagattctttgatggcaaagttactgttaaataggacatctatatattctaggttgttcaggcataatctcagtttatacctgttatccagacataattaatgattgtgcaccttttcttctcagaaatgtataagtttggatgatatatcgtatagcaccctaccataaaagccaggaagggaacagctgtgctatttactttgcatgttacctactacattgtggagaattacagaacatgtaacattatcagtctcatgccttttctgaagtattgtagttattctcatacagatatataaaaaaaaatctgcatttttacttcacaagtttttcagattgagggcctcttagtatatgaagcaaaaatactttttagatttgatttttgaaaacaagtaattaaggaatctgaaaatgaaataaaagcaggttttataagcatcttaaatctcattttgccttacactcatagagcttctgattgtcttttttgagacggagtctcactctgttgcccaggtgagtgcagtggtgcgatcgcagctcactgcaacctccgcctcccgggttcaagtgattctcctgcctcagcttcccaagtagctatgattacaggtgcatgccaccatgtctggctaatttttgtatttttagtagagacggggtttcactagccaggccagtctcgaactcctgacctcaggtgatccatccacctcagcctcccaaagtgctgggattacaggcatgagccacgatgcccggcccacttctgatcgtctttaaagatagtgttaaatgaagcagcttgtagtaagttagcttagtggtgggctcaagaattagtagatatattttggcaaggtagtggtttattaagcattgtgtatatttttaaaattttagaaatagttattttggaaagagaaccacatacttttactactctcccaataaagaagagggtcggtttctaaattttttttttttttttgagacagtctcactctgttgcccaggctggagtgcagtagcgtgatctcagctcactgcaacctctgcctcccgggttcaaacattctcctgcctcaatctcccgagtagctgggattacaggtggctgccaccacacccggctaatttttgtatttttagtagagacagggtttcactgtattggccaggctggtctcgaacttctgacctcaagtgatcccccccacctcgccctcccaaagtgctaggattatgggcatgagccactgtgcccagcctaaactttttttaattaacttttttgtttgtttgttttcagacaggatctcactgtgttgcccaggctggacacatactcctgggcttaagtgatcctcttgcctcagcctctccagtagctaggactacaggcctgtgccactgtgcccgacatttaaacttattaagggtgaagatgtgtatctgaatgtgattggtagagaaatgtatccatttctggtttatggttaataaagagttaggacggtttatgtttaagaaagcaatcaagagcctggtttaatcagtaaaagtaggcagatacttagttaagtgtgctatttagttgtccacatctaatttattatacagggtcattctaatcgttaaaactacattagccaaggagatggattcaacatggtaagcctgagagagctgtagatatgtaaaaataaatattttaattacttctttctttggagaaataagtcagtgcaggtacctttagaagaactaacataaagaaagatctctttggggccaggcgcggtggctcacgcctgtaatcccagcactttgggaggccgaggtgggcggatcatgaggtcaggagatggagaccatcctggctaacatggagaaaccctgtctctactaaaaatataaaaaaattagccaggcgtggtggcgggcacctgtagtcccagctactcgggaggctgaggcaggagaatggcatgaacccgggaggcggagcttgcagtgagccgggatcgtgccactgcactccagcctgggcgacagagcaacactccgtcttgaaaaaaaaaaaaaaaaagaaagctctcttttataaaaagcagagataagtggattaagggacagatttaccatttcttgtctggacactgttgttgtctaacttcatttgcctaaaaataaagtggaatttctgttcctctctaccatgaaggcaaaatggaacaataggaaaattttctaatgtacttatatgaaagattgttacaaatacaaggtagtggtattatcttacaccacaggttaatttttccttgtaaaaatggcagtgtggctcgcacctgtaatttcatcactttgggagaccaaggtgagaggatcacttgaggccacaagtttgagaccagccggtcaacatagcaagacccccatctctacaaaaaaatttttaaaatttagctgagtgtggtggcactcaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcccgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttatttatttattttttttttttgagacagtttcactcttgttgccaaggctggagtgtagtggcaggattgtggctcactgcaacctctgcctcctaggttcaggcgattctcccacctcagcctctcgagtagctgggattacaggcattcaccatcactcccaactaattttttgtatttttagtagagacagggtttcaccatgttggccaggctggtctcgaactcctgaccttaggcgatccacttacctcggcttcccaaagtgctgggatcacaggtgtgagccaccttgcctggccagttttactgatttctaatgttaaaaacctacataactcagaccagtagttctcaaacttcagtgagcattattaacacctggggggcatttttaaagcacatgttgctgggcttcaccctgagagtatctgactcagtaggtctgagatgtgcctaagtatttgcatgtcttacaaggttcagggtgatgctgctgctggcaatccggaaccacacattgacaaccactggcttagagcagtagttaccactacttttttattttctgtcacctaagaatgactacacatttctgttagtaatggctgtggctcattacagcagggattttcgctagaggctgtggtgaggtttgaaaagattatctttggatgaaaattctgagactgcttctcactttcccctaccaaaattagagccacagaaccaggaagccaataaattattaagcccttttttcttggcatttgtactcaaagcaaatagaaaataatgtatgtaatctactatagcaattttaatagacctaattcaaggagtatgtacaagtcaatagctttgtggtttagcagccaactcctaataggctgtaatctgacataattctactgtcttggctcttgccccagtacgacagatgattccataattccccccaaattgtagcttttggtagaagtaaataatgaaagacttgctcaggagccaattttatcaccatcagtatgttaacatatactttaagaaatacaagccaggctcggttactcatgcctgtaatcccagcactttggaaggctgatgcgggagaatcgcttcaagccagggctatgagaccagccctggcaacattgcaagactacatctctacaaacaatacaaaaattttaaaaattagttgtagtggcttgcacctgtagtcccagctacttgggaagctgaggcaggaggattgcttgagtccaggagtttgaggctacaatgagctatggatgtgcagcctgggcaatagagggagaccttgtctcaaaataataatagtaataataataataataaacacaggtaactatctgtcttagaaacaagcaatattttgtgccaaaaatgcatttcgaggttaaaagggtagagttttcggttgaatacctttgtatttcccacgaatacttttgactgctgttgttgatattgattgagtttcagccttttgtctcttaaccaaaatcagaaaggctccatagtaattcatagttggggaaacaccactttggagatgatggcagggaataatgccagtgccattctttcactctatcacaaattatgtctgtttaggtgcagctcactctgcttactgccatagtgaagctgtttctcaagaaaccatcagaaacacaggagctagtccagcaggtcttgagtttggcaacacaggtaagaaatctggaaaaagcaagatgttgatttgtcttgtttcaaattgtaggaaattatgaaactcttcctaggggattcatttggggaagctttatttgaaggaagtatggcctttagatcctgttaaaatattaaaacaatgcctttttacgtgttcaactgaattgtagctaattctgtggcttttaaatgagttgactgattccagttttcataattcatgaaaattgaacctagactcttagtttagtgaaggacatacttagatgaaaatgacgtgatctgatagtacctgcttcactgtgacttcatttcagctttcaaatgaaagtggagataatagatgcctcagtaaagtttcatgcattgttctaccttccagagtagttgcctttctcacagaaattaagtgtttatgctgcttccttgtattatttgatatatttggatctccttggaattatttgtttttttaggtcagaagaaaagaagtttagatggattcagatctcaggaaagtggcagctggctttaaatatcaggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaatggaatatgattcagatatccagtttaccatttttctgtctttgtcatccctttatactggtgtgtaatcaaaatttaaaaccctttcacagtactttgcctagttctgagccataatttttcctgttattacaacttaaaaaaatgtatttgtatgagctttttgaagtattttaaaaactttcttaagcatcttcctctgcctgaagcaaagcaattataaacatcagtggttaatattatctgtattgaattgagcattctaatttcctggatcccatttgcatctctaagatgaattcaaaacaatttctttattcctcccacaccccccacagccttttttttttttttgtactctgtttcatgttttaattttaaactcctaagtcaggagtgtccagtcttttggcttccctgggccacattgggaggagaattgagaattgtcttgggccacacataaaatacactcacaatagctgatgagctaaaaaaaaaaaatcacaaaagaatctcataatgttttaagaaggtttacgaatttgtattgggtcacatgtggcctcaggttggacaagcttgctgtaagtggtcacatagaatgacattattagagcagctcacattctgtcaaaacaatttctaaagagaattttggcctttcttcctctctgcttactgtaaatattcaagcaagtatgtttagtagtttcctctgttttcacaagttctcaaccttatcatcattgtctgttaaagcctatgtgattgtatttaacaggcaccataggagagctgtattacgaattctggccagacttcaaactcagtctcattacctcttaagtatttatcaaaatttgactgagataaagtatttaggaaggattgcttaaaggatacaaggtagtgctgttcttacagatagtctgaaattcacctctgaatcaagcattattaatagacatctggatacctggactgcattgtttttgacccctaataaaattgcttttactaaattacgctgatactaaaatactatcagtctgtagtaataacagtcgtcatgggaaactaccctatttggatctgttgttagcttgttatcagagtcattacttacttcattatgttttcttctttatgaagccccatcaaatttctaacaagttttggatttttctgtgtatcagtgtagcatgcctgatcagctttcttttccatattggttgtttgaaaccttagaatcacatttaacaatctcccatggaaactatgtaggccactgtggcatgcagtttcctgactctgggtttaattaacgctctttagccttagatgcatttttcataagcttcctagaacaggacaggctagaaactcacttaatcctagtaagggttagtaaacgatttctattttatagatgaggaaactcagagaggcctaattattatggggcagaactaggactcagactcagatagtctggctctaggtcttgcccacggtcttgtccactgtgctatgcttcctctctagtctgaaggttaagaatgacttggagaatacctattccctgcctgaagcaatattgagcataagcccatatgtatatgtgtgtttgctagttttaaggtctttgtggatgattatttcatactataaataataagcaacttctcgaggcttgccttttttcaagactgagtctagctctgtcacccaggctggagtgcagtggcgtgatctcggctcactgcaacctccacctcccgggttcaaacaattctcctacctcagcttcctgagtagctgggattacaggtgcatgccaccacgcccagctaattttttttttttttttttccagtagagatgagggttcaccatgttggccaggctggtcttgaactcctgatctaatgtgatcctcctgccttggtctcccaaagcactgggattataagtgtgagccacagagcctggctgaggcttgctttttctgtccaattaattaatgaagtctgagaagttatcataaaacagtaagtatgctgctgggtgctgtggctcacacctgcaattccagcactttgggaggccaaggcgggcggatcacttgaactcaggaattcgaccagcctgtgcaacatggcaaaatcccatctctacaaaaaatacaaaaattagcggagcatagtggcacacgcctgtaatcccagctacttgggaggttgaggtgggaggatcgcttgagcccaggaggcagaggttgcagtgagctgagatcatgccactgcactccaggctgggtaatacagcaagactctgtctcggaaaaaaaaaaagaaagaaaaaaagaataagtatgcctatgtaagtctttttacctggaagttttctgttttttccccaagtttgtgaaataagaacctaaatatttatggctagtgagtaccaatttaagtttaggatgcaatgtggtcggctgaattgtgttaacttaaattggtatatgtgctgccgaagcgagcacatgttaacttaaattgggtagtgaggttctgatgatgctacttccactgattctggacatgactgagcaaatttctttcatactgcttttcttctgtctctatagtagagttaattaatactgttctttacctgtgctgagaattaagtgaagtatatgtgaaatcttagtgcttttaagtaaaatgggagtataattaaaaatattattagttagggggaaaaacccaacccttgaatctgaggcttcatttcaaaaatttatctttttctcttacctgttacacagaaattcaatacaatattcagttcaactcagtaaagaatacaaacaaaggccgggcatggtggcttatgcctgtaatcccagcactttgggaagccgaggcaggtagatcatctgaggtcaggagttcgagaccagcctgaccaaaatggagaaaccccatctctactaaaaatataaaattagccgagcgtggtggcatgcgcctgtaatcccaactactcgggaggctgaggcaggagaatcacttgaacccgggaggcagaggttgcagtgagccaagatcgtgccattacactccagcctgggcaagaagacctagactctgtctcaaaaaacaaaacaaaacaaaacaaaaaaatgtctagacgttagtaattattctttgtgatacatggaatagaagtcttcatgtttttctgtctatgaactaggggccaccatcatcagaatcatttgggctgcttgttaaaaatactaattactaggccctacttctgatgtaatgaatcagaatctctgaagtatggcccctgggttctgcactttcagtggcattcctggtatgttaaaatgttgatgcacattatagtttaagaattactgttttagtgctggcctggtaagtattgttttgggacctcttcccctgaggaaggcctatgggtctagcagtacagtagatccaaagccaaattatctgagtcaccaaacatttaatggcaacttaagattacaaaaaggtcctgtatttttatttatctcggtcttgacagtctgaattactgtggcctccatgtaaaatgtgaggcagttggtgaggactggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggtggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgagatttttgaattttgtgaatccctataggaatttttctttttggtcatttggttaaattgtttacattacatatgggagaaataatttgaagaaaaagcattttattttgatgagtatattattaaactatgtattataaagttgaatacctttaagatattactagtccataaagacaaactgaattttctaagttaataagataaatgcagtgtttaattatgtaataaaaaccatactttacaaattctaaagtacatgtgctttaaggactgcatatataggttaaaatttaacgtttaagttacgtataaaaaaatgtgggagagaggagttgcttccctgacctgatattttgagaaacttgtattctgctcttttaaaaatatcaacttgtttttgttttataatgttcaagctttgttttcaaatgaagatctaaatgaggaggtttcaggctgctatttataaacacttaggagcaaattagtccctcagtgccccccctccccacacacacacaaacaaaatcaactaaattagatataattatcactgtttcttttttttaacccgggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatatagtcaaaaacatcagggtaactactgctattgaactggatgataagggccttaagtggctaaatcgtgaatcaattcatctgctcgcttagaaactaaaatggaagccctcagattgtcctgttttaaagaaaatgttttttgtttggttatgagttttttgggttttgggggtttgttttttttttttttcttttgagacagagtctcactctgtcatccaggctggactgcagtgacttgatctcagctcaatgcaacctccacctcctgggttcaaatgattcttctgcctcagcctcctgagtagctgggactacaggcatgagccactgtacccggtctggttatgagtttgaaatatagaaattgaaacagggacttattgttgcctttaataagttgctgttggaacaactcgtgcataaataaatgccatcatatagacatacttttgaggtaggtaccaggatatttattgccactttataatgatgacaaaaacaataaagaaaacaataggccagacacggtggcttatgcctgtaatcctagcactttgagaggctgaggtgggcggatgacttaaagtcaggagttcaagaccagcctggccaacatagaaaaaccctgtctctactaaaaatacaaaaattagctgggtgtggtggtgcgtaccaataatcccagctacttgggagacagaggcaggagaatcacttgaacccgagaggcagaggttgcagtgagccgagatacgccactgtactccagcctgggtgacagaacaagactctgtctcaaaatacatgcatacatacatacatacatacatacatacaaataaaacaataataaaggtagaaagggaaaaatgggcaacagtgaaaatgtccctcaatagtggactaataattaatggtgcagtgggcattacagtggaaaagtgcagtcgtatatatcaacatggagagcaacttcagaacagtatatataatatgaaactggttttatatgaaataagtgtgtgtgtgtgtgtgtgtgtgtgtgtgtgtgtgtgtgtgacccatctggacagatatataccacattactaatcatggctatttgggggattgggagttgagatggagaagggttggataattgggggagattttttttttatgtcacacacttaaaaattgtgatgtggtatgtttggtaataatttctttttagccatgaacatgtatacaattatttaaaaaccaccatagcacaaaacaagaccaccaaattcaagtgttactccttttggaagcagttatgtcctctctttagcagtttttgattatttagataatagtacctttcatactctattgaaatagttaatattacgtgagctccttaaagtcaggcagtgtattgttacctctttatttccagggcttagccagtgtctcaataggagatacttaataaatatttgaatgaaggaagaaggtatgggtacaatatatggaagatataatatatgttattaataagcctgctaatatttaaagcagttaaaaaaaattttttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaagccaccgcgcccggccctagtttaaaaaatttttatgtcctaaggccgtctcaaccagttaacttttgccagattaaacattgtttttctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcctgggctcaagtgatcctcctccctcagtttcctgagtagatgggactacaggtacatgcggctctacaccccgccctgataatttttgtacttttattattattattattttttgagacagagttttactctgttgcccaggctggagtgcagtagcgtgatctcggctcactgcgacctctgcctcctgggttcaagctattctcctgcctcagcctcctgagtagctgggattacaggcacacgccaccaagcccagctaatttttgtatttttagtagaggtggggtttcgctatgttggccaggctggtctcaaactcctgatctcaagcgatccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgccttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctcttctttatgcttttatagtctggaaaagaactgctgtacatttttgcttctttatgcttttatagtctggaaaagaactgctgtacatttttggacacctactactatacaaccccagggagctccatctgaataccagtgaccacacataaaatcggtgaaagactcctctgtgttccaatctaggagtacattatggctttagaaaattgtggtgaagaccttctaaattgataaagtctgaaagttgcttaagtctgcagtaagaagagactagaaataaccccatagttgaaaacttggaaaaaagcctgtgtatacatttagccatcttgatccattactgtagcttttgttgagccttctggatagttagcaggtataacttatgctgtaaagctgttaatgaaataatatttcagtattgttttatttaaaaaaaaaagcctgacttctatgtggacttagtttttcagttacctgtacttttttatattggccatatcagcaaggaaattgttatgaaaaggctcttgggtaacatggagctcttgctttgtagctatcttaaaattctaattaggcagaagaaacactctaataaactcttacaatgggtatctcagaatcttttcagaatctgattccttcatcaatcatagtagaccttgattgaagtaggatttccttccagagtagttagaataattgggcttctattaatgagtgtcttgtaccattgtctaatatatattattgtttaagtggtttttgtgaatggccaaagtataggatttattgctttacaaattggcgtggtcagcattttgggttctatgtaaatagactgtggatacagataaaggaaaaaaaaaacagcaatacccaaggagattattaatctttcataattgagttgaatctttgggtttacagcaggtgctataattttaatccagaggagatgtgagcttcataaggattagtctttatagtaagttagggtgtttctccttgtaggcaaacatgtttaacattctatagatgagactatttaacttctaagaatttctcccagtctgtgcttcaagtttcgatgtagatacggattttctgttgtaacttccctctgtaaccgtgtttgtatctagcctcctgctaacttttaaccctcacatggaagtggggaaatgaatcaacaaacaaaaacaacgctttcttaaacacagggagagaaccaacatttaaactgtctaaaaagaaagtgtcttacataaggcttttatctgattaatagcctttaagttcttatcttcacaatttcttttgtggttcctttttggataacctcctttttgtcatttgtgcatgttttgtgttttttaaaaaaatgcaagtacagggaaaatctgttttgatataaatgggaatgatacgttgctgcaaatgacatgtctgtaatagtattgacattacctagctctcttctgcaatgtgaggttaataagtgatacacctctcataggaaacaaagcaacactttaaaccttattctgcatcttctagaggtttaaaaatactcacttcactaggtcttttaaaatcatctgggaaagagagaagtgatttttacttggatattgcttactatgcttatacttgtcagctgctctatgggggtgaggtagtaaatagttgtctaattcagaaaaatctcacctttaaaaaatattgctttaatgacagttatgcagttatttcccttaaaattggaaatgtctttatattaattttcttatattttccattgagaaagatgtataataatgatgtatcatattcttgtagaatctataggatcatttatatcttttcattgaactcactttatcttctcatattattcattcctttccattagagtgaagaaaaatatgtgcatgatacctattctaccttctttttagacatactgatagaaccatgtgttctgtcacattttctaaatggtatgtcagaagatgacagaatttcatgtgtagagaatactctgtgaaagattttatttatttcttgtcaggtgtatgaaatcatttcccctttttacttctttcttaaagccttttcatcatggcttcctggacactttccttgtaaattagctttcctagattgtatttctgtctttaatctttgcagttccatgtttcttctcttctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaaccttatgcttcagtgatattgttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctcactgcaacctctgcctcctaggttcaagaggttctcctgctacagtctcctgagtagctgggactacagatgtgtgccaccacacccagctaatttttttgtacttttagtagaggtagggtttcaccatgttatccaggctggtctcgaactcttgacctcaggtaatccagctgccttggcctcccaaagtgccaggatcgcagacgtgagccactgcgcccggctggaatatgaacaggttctgaattatcgaccccagtgctctaccctgagactctgggcatgagccaccgtgcccagcccagtcccttgttgctgtcaggcttctctacttgtttttcttacttatcttaacagaattgaaacctgcacatataatttttcctgtcgtccttctagagtcccctgtgattattagctaatcttttgcttcttagtttttgtttgtgtcaaaatttaactaggcttttttaaagaaaacatttgttttttaattaaatttttacaattttttttactttttttttttgagatgtagtctcgctctgtctcccaggctagagtgcagtagcacaaccttggctcactgcaagctccacctccttggctcaagtgattcttgtgcctcagcctcctgagtggctgggactacagctgcctcctaccactcctagctaatttttttgtatttttagtagagaccgggtttcacaatgttggtcaggctggtctcgaactcctgacctcaggtgatctgccgaccttggcctcccaaagtgctaggattacaggtgtgagcctctgtgcccgcctgtttttttgttttgttttactttttatcatataaatcttaaaatatgcaagatagaatggtataacaaacttggatatacctatcactcagctttagcagttatcagtatcttgccagtcttatttcatttattgcccatacagttgtttttgaggtggctcaaatattttaaatccaatcccagacctcgtatctcttcacccgtaagtactgtacttggtatctttaacagataaagacttgaaattacaatgttatcaagcctaacaaaattggacataattacttaatatcatccaataagcaggctaacctactttgatattttctcaattgccattctctagtctcgtttagagtttatttaagatcggctttactttttccttaaatgtttggaggaattcacagtgaagccctctgagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagaggtgatgtttttggtaaacaagctgggtaagatttgccgagttccttttactgtttgtaatctttccttagagcatacctgtgttggattaacagtataaataatagggtgtttattatattgtttattaatattaggctgtcagtggattattccggtctgatataagcttatgcagtggagaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttgctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgtatgagttccatacatctatctacattgtcagcaatgcttggtagtttagttttagttttagccattctggtgagtgtatagtggtgtcttgttatagttttaatttgcattttcctgatgagtaaagttgctaagcacattttcatgttactgtatcctcttttgagacttgcctatttttaatgatttgtctttttcttaatgatttgtaggaattccttatataatttggatgcaagtcctttgttagttatatgtgttgtgaatatcttctctcagtttgtagagaatatcttttcccaatctcttaatggtgtcattggaagacatgttcttaattttaatgaagttcagtttattactttttttcttttgtggctactgctttttgttgaaaccattatcttctccaagcttataaagatgctactctaggttttcaactaggttttacctttcacatttatgtctgatttatctcaatttttgtttaccttgtgaaccatagggggccaaggttcatttttcccccacatagctatccagttaacccagcaccatttattgaaaagatcatcgtttgtcctacctagtccttttaacatgtcttgaaactcaccactttctttttatttttattgcctgttgagttgttgttatttcatacattgttgattacagtagcagtttagattactcttagctgatcttcatgtccattctcctaacttcagtccgttatacacacaggtgctagaataatgtttctctaatgttatttttagtttctgttctttgttcaagaaataaaagtgattctgcatttcttatcatataaaaaatcaactcttggccgggtgcggtggctcacgcctgtaatcccagcactttgggaggctaaggtgggcggatcacaaggtcaggagatcgagaccacggtgataccccgtctctactaaaaatacaaaaaaaattagccgggcacggtggtgggcgcctgtagtcccaactacttgggaggctgaggcaggagaatggcgtgaacctgggaggcggagcttgcagtgagccgagatggcgccactgcactccagcctgggcgacagagcgagactccgtctcaaaaaaaaaaaaaaaaatcaactctccagactagttttcaaagttttattttccttattctctcttcctccaaattttaccaatcccaaactctgctcctgccaatataattttttcaccacccctaaagtcaaattgttcatttctgtgcctttgtacaaaccttctcttcctctttggaggtttctctctggtagttcctcataaaaccattccgagaagcttttagaatcagcaccgttgattttgttgtgtttctctctcatatcctatcaattatgcagacacacaatacatgtttctgctgttacacagtaaacttgctttttattcattttgtaaatgctgatttttttgttggtgtgtgagccattcagggcaggaaccatatattttacagtttctacagagaaccatagaattctccttacagtgttccctcatagacgtttaattaaaattgaccaattatattatataactgacaaggtttacataatataatttattttcattttagcagctgtattttgataaaaataagaattgctattatctcttcatgaacataaacaaatggttataaaatcagagagtttttcccccttgtatttgatagttatatatagctatatgtttcactgttgttgcgatgttatgtcctaggtgaaactgacttttctcttttctccattttatgtgtatgtgactttagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtaagcatctttcttcccttgttcttttggttatttttagttcttgatatgctagagagttttaaattattcagctttttagaactagacctttccttgatgagcagtagtgtcctttgataaaggacaggattctttgtctttagtaagacaaaattataattaatactgttcatcatcggtaatggggtatgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttcttttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgtttctgtacaagataaatgaattttaagggtgaccatcaatctatgaagagaaggccagaaaaataacaagtctattacaagactgcctacatagtaggtacttaactgtggtggaattagagaggcttttctagctagacccttgcaaaagagatttttgtcaacccaatgactataaagatgcccaacaacgatttatttaccaatatcattggagggctgacatcttagatatgaaaatatgtgttcccagagatgacagacacaaaacaactgcactctctgctgcatatactggcatcttctcttctactttatgaggagttttatgtctgggatttataccagccagtagaggttcatttactttttggctagcagagagtctaaggaaatagggttatagtcatatctctgtgggttgtgcattttactaatggaaaatcactgcttctagaatttatacattgaccaagctgtggactccagcttatattgacacaaatgagcacttctgttgtctttcttgggaatataagcaaatactttttatattcatatctttaatgattgaaactgactgaatagcttcctcatatgatcattctacttatattgctgtatagcctccttatagactccggagagtgacaaatatttaaatgttcatggaggctcctaagaatcccttataaaattaaaatagctcttccttttctgttcacattcaaccacaaattaaatattgcatcctcctcaagtttattacattccctggtggggaagcttagtaaaggtggactcattgaacctaaaaatgagaaacaaacttcaagggatagaggggagaaagaggccctgccttttcatgttgccagacccaggaccctgcttgacccactataaacatagaaaaaaagagacatgttactttcatttgactttgtattagctcatgccaactccaaaaccaatgggttttgtcatcatattttacatagctgcccagtcatctgcattagaattcctgcaagtattgtatcaaagggaaaagctgttagaacctgcttggattgtagtagccaaagttgcacacaggcctatttcctttttttttatataagggatattcttttggggatgggaaagttgttgtttttctaattggatttctaaatatgcaacctttgctagataggcccagttatgtttttatgtaactctaaattttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgagacctagagtctgcgtttctaacaaggtgacactgaagctgctggtccatgggccacattttgcatagtaaggacatagaatatcttgtgaccactgtgaactacttcagtttagtgtttgaactgtagctacctagatgctcagatacctttttctttttctctctcttttttttttttttttttggaggtggagtttcactcttgttgcccaggctggagtgcagttgtgtgatcttggctcactgcaacctcacctcccaggttcaagcgattctcctgcctcagtcttccgagtagctgggattacaggtgcccgccaccacgcccggctaattttttgtatttttagtagagacggagctttaccatgttggccaggctggtctcgaactcctgaactcaggtgatccacgtccctcagcctcccagattgctgggattataggcgtgagccaccacgcctggccctttttctcttgacttcagtagtaaacagacttctggaaagagggctcctcctctcccttaaattaattcagagggcaagaaacttattaaattattttgttaaagctctttcttttgccctgtagggagaatagtgtagctaggagtggtagaattcaacccaaacccctgtttaaaatatggccatagttagaattgtgtggtggtttgggaagcagcgtttaggttagctcagtgatcatttcaggaaggctatcaaccaggccactagactgttggttctatttttatcatgggtttctaacagaacctcacccatagaggccagtggtgtactgctaacaaagtattgcctggttcctgatgaccatatggttctcaactctatctgcagaattggtcccacataattaccagtttaaaaaaaaatactctctagccattgaaactataaagaaaaaaaatactatcaatacttgagtccaggagtaattaaataccacctctgggaggcaggacctagacattgctatttttaaaaagttacctgggttattttaatcttgcagccagtgttgagaacattaaaccaaatgaaattccaaatggagttaggtagagatgttaaaaactgatctctaagccaagacagtgaccgccacagaagaatcatattctcgagatcctctttggcacctcctacaaaaacagatatctctgactttacttttgttcttttccccctgaatatttttctgttatgatattctgtgaggttatccatcgtgtcagaagttgactggaagttgaatttgaccaatttagatatggtcgctcagtcccagggtcctttttatccttgcttacttgccataattggagaccgaaaattgagggcattttatattttggattgtctaaccattttctattcttctatcttaaaacttgatattcatgagaagatatttttattcttcctttttcatagcctggtgatcttcccttagatcttgttctgtttcatcttcttttactgtcacactcataaaattcggccagcgttaagatgtagtgagttgtgaccttttcttattaggttggagcaaaagtaattgcgatttttgccattaacagtatttacttttgctccaacctagtagaactgtcacagtcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtgacctgatgcccatgtgtataactcttgcatatgtgttatgtgctcatgagtctgacatctgcgaggatcactgaagtaataattgaatctcaattattttcttgcctttacttccaatctgtcagcagaggccttggctaaattacagccttttgttcatccaaggtgctgtgcattattcttttacataaacagtgctattgtgtatatcaaaaatggaaaggaagaattatccaaagtgccctttctctgtgctgatgaaggatttcatcctggagaaatatgctgtgtgcccagcttgagtggtatggaattgaagagaaactgccttttcctgaccctcagtccatgtttttcccactgtttctttcaggtttttacctttcagattattaagtcataagctatttattaatagttttgagattttttagcccacaggaaatccatcatctatactagttttgcatctttatttttcttcctttggaggagctttgcaatgacttaaaagtttagtttttagagtttgtgttatgtggaaagatctttgtaagttgttgcctgttaaatttctcagtgaggcttccataaccaccatctttgtatcagtgcatacgtttagtcaaggctggcctcagacagttttgagaataattactaatttctgagttctagtccctgtgctagaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaatacagcttgcttgccctgggcctcttgatggtgtacatcccaggtccctgagtatatgagtttgggttaatgtgtcacatgaaagttggagaaggactacagaagtgtgttcattcatgaagaaaagagactgaataatgagtaagttcatgcacctttcttgcagcaagaggaacagattgttcatcttatccttatttatttatttaaagacagggtcactgcaaccttgagctcctgggctcaagtagtcctcccacctcagcctcccaaagtgttaggatttacaggcatgagccactatgcctggtcattttattttcatttaagtaaaaccacaaaaatctccgtttcccatctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaagtagctgggactacaggcacatgctgcacacatggctaatgggtgttcattttttttcctcagttggttctattcatatgtttgtcaatgttgatgcagatattgtgctctaagtaaacaattttgtcaggcttttgtccttttggtgataattttccctaataaaatgattcacttcaagattgtctcccaggaaatactgccagtagccatatatatattactgccagtagccataaatttatatttacgaaacattcattcattcaataagtaaatatttgagtgcctagtattcaggctctattctgtgtactaggcatatagaatggtccttgcaaccttacgaaacagtccttggaagcttacattcgcgtaggggagacaaatgataaagtagcaaatgctgtgaaacaaagtgagacagaataaagaggttctcttgttgatttttactatattcatcattgagttctgtctgacctaagagacctgtggtgaccattctaaggactttttgtcttacatcaggaagtaatccgttccatccccctacttttccactgatagaagccttttcccccctcaggttatggagtcttctgatgatttttatatgatctcaatgcgtttatgctattccttatcaagtctgctcttagccatcagtttattagcttttgcatggttacagagtctttccaccaatttgattaattatattttatgatgctttttggaatagctttttttttttttttttttgagacaggatctcactctgtcacccaggctagaaagcagtggcactatcacgacatactgcagccttgacctccctgggcccaggtgatcctcccaccgcagcctccgaactagctgggtctacaggcgcccaccactacacccagctaaattttgtattttttgtagtcatggttttgccatgttattcaggctggtcttgagctccggggcccaggcaatccacctgcctcagcttccgtaagggctgggattataagtgtgagccactatgcccagccttgaatagctttttgaagatcatattaaaatttgcagcctagtagctaaaaaccatactttaacctacaagatactgtgtgccatctaaaatttaaactctgttagaaagacacacactgatggttttgataccaataggattttgacgatagttaagttttattgtttgtgaagggaatcattgtatactatttttgcaccattctgttgactcctgaataatagagctattggtaagctatatggcttggagcattccttagattcccttcaattcagtaagttctagaaaacagtaaataaaagagacactagctctaaacaggagcatagaaatgtctgagcttaagatatacacctgcagttaagagaatgtcttcagatacctagacagctccacagttttagaagcaaacagatgtactttggactggccagacataggtcaaaggggctaacccagatcagtcattatgataatttgtgggattttttttccagtccgctcagtggttatctcagatgatattcctttataaaatttaaaaattccttttcaaattttcttttcttggagtcaggcggatttattcccctatataacttcaatcttgagttccttctctgtatttctgctgttgtagcacattgccattggacaggggcatttccttttgttatctatagctgaactgagcctgtatgcaggctcagctctgagacttttggctctacctggctctacagagctcatgtaaccatgccgaaatccctttagcccataagttacaataagtcaccataaaacccctgttttctgtccagttactgaacattattgtgcaatgacacattattgtgtagtttaacatgaaccaagttccactcagcattacttcagatgtggtaaagtgaccactctttggcagtagacaaatgttagtattattctcagtgccatttaatgagtacagcaattatgggggactacaccactagcagaaaatttggatttaggtatcagttacagttttttaatacagactgttcaattctcagtatttgaaatattcttttcctgaagttgccgtctttcccccttctttctgtatctgatttagttgacctataattgacatcattttcttcatggagaaaatggcagcctcagtaaggcaatcctgggaacaatagtgagtggacacctccaagagacacttaaaacacagtatctagacatttaagatcaggatcaaagccataccctgcactcctattccttttccctcctgtctcctaccagctcactggataacagatatcactctgagttttacaagttctagtttgattgattttgtaccctacctgataagtatgggcttagagtatgtccagacagatgaacctgaatcccaataatctcaggctgggtgcaatgattcatacctgtaatcccagcacttcatgaggctgaggtgggagaatcgcttgagcccaggaagttagagcccagcctgaacaatgaagtaaatttttttctttaaacaaatagtgtccaactgaactgaaatagctactgtctagttcaggctgatatacaacaactttcttgtgtagttgttcactttctagctttcttttttcttgatgagtatctccttcctcctgtttatcacttgtagataggagaggccactcactgggtaattcgcttccattcctgctgacatctccctattagtcactcacacccatcatcatgctgtcaccttgccatggtttcagagagtaggataatctccattagaatatttttcagttaagagggaagttgctgaatagtccgcataagctgtagtcttgctagttagaaaacatgtatagtattgaaattgtcctttccctttgctctctgaacatagtacaattaggtgaacctttgtatccctggctgtgtctctgatatcttttggaccctgtctttgtgtcagatcagagttcatgtttctagctgagttgtatctgatatactgaacataaacagaggaatgtcaagattgcttttcagttcttcatgattttgaataaaattgacaagcactgggggacagtactttcagatcctttccagctaagataatattcatatatcattcaacgataaaaagaatgaaatctaagaaaataagggctatgaatgtgctttctttcctttggtctaaacactacccatgaatctcttttctcaatgccttttattgaatttagcaaaactgctgtttcctttccaatgtgtttttctttcttgctgttctgtgccaagcaggttcataaagaattctatctctttgaatcttggattataagcctagccagaagaggggagaataagttgcggtgagagggggtaagcccatcagaaagtcgaaaaccacctcagagtatcaggacaaatgaaacatttttcgtaggatcctttccatgggttttcctcgctgctcaaattttttttttttttttttttttgagacggagtcttggtctgttgcccaggctgtagtgcaatggcatgatctcggctcactgcaacctctgcctcccaggtttaagcaattctcctgtatcagccttctgagtagctgggactacaggttcccgtcaccaggcccagctaatttttgtatttttagtagagacgggtttcaccatattggtcaggctggtcttgaactcctgacctcaggtgatcaaccggcctcagcttcccaaagtgctgggattacaggtgtgagccaccacgcccggcctctctgctcaaatcctgacttcctttttattcacaagttccaaagtcatttctgagcagatgaagtcttgtctgactctaaataactgattctctaacggcagtgttttcaaccttggctgtacattagaatcaactggggaagcttttcaaaattctgatgcccaggctacaccccagaacaattaaattaccatctctgggggcgagtactttttaaagcgctactctctgcaacccccacacacagatggttgattccattgtgtatccaaggttgaaaccatactactgaaacataattgacatagttattagtattcttagaaagcttagtctaagaaacctccaggtttttatgaaggggaaattaaaaaattaaaagacagcctttgcaaacttattttgtatgagtatttttttaaaacacatatcaaccctgtgttccagtctaactggccttttcattcttccatgctttcttcacctttgttcatgctatttgagaaatggccttcccccatttttgctttttataattccaccctaccacctttttgaagtttctcttcattctttcagccagagggaggttcttcccttcagaacttcgcttttttgctttagtatattctgtatggttttgcatttgtgttttatttctccagctagtttgcaaagcttcattcttatctatgtagtcccctcattgccaggcatctttatatcccttgtaatgccttgcatccagtaaatgttatgtaaatgtttgtttgaataaaaggaatttcagacgtcatgctgcagatgtgtgctatgatagaactagggagaaagcagatgtgtaatatcttttctattcccttcacacttttctagttactcaaattcttggtttggggatgcctttttttttttttttccgagatggagtcttgctcttgttgccgaggatgaagtgcaatggcatgatctcagctcaccgcaacctccgtctcttgggttcaagggatgctcctgcctcagtctcccgagtagctgggattacaggcgcctgccaccacagcctgctaatttttgtatttttagtagagacaggatttcaccatgttggccagggtggtctcaaactcctgacctcatgatccgctcaccttggcctcccaaagtgctgggattacaggcatgagccaccacgcccagccaaggatgatctttttatttatttaagtatgtgattttcatcccctgtgcaaccattaagtagtcttcaggaatcagattctggaaatgttagctctggtttggaatgcttatagtttacaacagagcatgcttgctaatgccagttatgaagcacctaccagggttattttctttcatggtttaaacagaactttgttgtagtcgtcactatttttcaatatttaagattaatttttagatttttgagaatgccattttatgtactactctctgttcattgagaagataaatcctctttccccaatcttaaagatacaaaataatttttacagctcaacgacctgcaactttctaccactaaatgactataaaggagaatgtgcttagagcagacaaggcatttgatgattcaaggaagtgttttagatgcacagtaagaactagggaagaaacaactgtggaactgtagcaaaaagtagattttgctttttaaacagctccattagttgtgtttatgtgtgttttacattgcctatatgccacctattttcagcttgagttctttaatgtttttgtcaaggaagaccgacttcagagtgaattatatctatcagaatcctgagaaaaaaagcaagactaagaccatgtggagttattttcttgtcagctaggtaattcagttagtctgattctctaatgcgtaacatcctttttaaatgatctccaaataaatccacatttctccttagtagaattgactgtgaaagagatttgaagcactgcatgcttccccacttcctccttagatagttcagatattttcttttttaggaacattccaaactctaaaaatcacttttgttccacctataatttttgcagcttgaagttgcagctcaatactagtttggctcttactttttcagtggggcagcaggttttgtaaattaaaacacattaattgttttgttttttggcttttccttttccaacacctccccaccctttccgtccgccccccactataagtttccttttaaagaaaaaataaagcatattcgaaatattgccgcttggggatagagcgtcttagaatatgcaaactctttaaatcttgtttgggtttgtgcctgtgtaccccagtgcaaagattggatctgaaacatccctgagatgtcccagctccgtcttctttccaagttttctccaaactgatacaccatcactaccaccacttagttcccctagtacatatttctttgtaatctagaatttttttaggctttgggagacaagttgaatggcatgtatttccagcaacttggtagagcaatttacagattctatatgggcatctagtatttagctaaatgaactctacctctctctcctctctctcctttctctctttcagcttggcagtgaccttggcgggggcattggaggaagtccggcagtaagtgccatctgtttttttcaccatgagaagcactgccccctgtttgatgcctttcctatgtacacattatcagaccagccactgctgctgtctagcactgcacaccaaaacctctataacagtatatgggtagtagaaagtagtatagggttacttggaattgttggggtcatgcaccacatggtgtagagacatctttaaggtttaatgttccagtgcctatagagatctttgtctttctgatattaaagagctaaaggaaatggacccttccatcttgactggagaatgcttattccctggtgtcacctagaaagaacttgagagggtcagctggactcagagtgagactctcctcgtaaatgagttagtttcaggggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttcttatcaatgatgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatatagtcttacctttctgaggaccaatttggctgaattctctgctttctaatctgactccttatgggggatccctgctatagagatgtagaccagttgtccattccaggagttgtaactgtgataactgagtgtgtatagttattacagtacatagcaaaaccgaagatattcaaaattgagccatagtgttttggcacaactcggtagctttgttgtaaggtttactatatgggatattatcttcagacttttaattattagttatctaatgcactcatttactaacataaaagtattgtatacaaatgaccaacgtaaataatgtaaaaatgtaagaaggaaaattgtctccccctgcccccatttcccatgtatagccactgttaactttcttgtgtgtcctttcaaaagaaaaagatcatgcccatagctgtatatttgtatcctttgaacattccgtgtcagtgggatatactattttgcaccttggtttttctctaccatattcttttgaatccgtatatctactgaattgatacaccataatttatttaatcactcctctgttgatgaacatttaggttattccctggtcctccccaccacctgccactcttttagtatggctgagtacattatcatgattattcaccacccacagatcctttggtattctgtcttaggtggtcagaacagctcatgactcctgatttttttattttatttttttttagacggagtctcactctgtcgcccaggctggagtgcagtggcgtgatcttggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgagcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttctttatttgttaaaaaatacatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactggttaaaaactcacatattgggccaggtacagtggctcatgcctataatcccagcatttgggaggccgagacgggctgattacctgaggtcaggggttcaaaagaccagtctggccaacatggtgaaaccccgtctctactgaaaatacaaaaatgagctgagcatggtggcaggtacctgtaatcccagctactcaggaggctgaagcaggcaaatcccttgaacctgggaggccaaggttgcagtgagccgagattacgccaatgcactccagtctgggcgacagagtgaaactccatctcaaaaagaaaaccaaacctcacacattggcagatgctgtatgtagagtgagccctggctcttgcaagccttttcagttatcagcttcaactctggaggcactagggagtttgttgggaaactcatccaaatgcgatgaagaaaccagaacttatttactatcttggattctaggattagaacgtttttgataaatttttaactgaaatccatttattcattcaacaaatcattgtttaacattagcatgagccagacatttctaggtactggggctagagtagtgaaccaaacaaagctcctgactgaaagttcacattttggtgggggaaattagcatatttggttggtataagaaatatggaagtatatatgctgaacaaataatcacataaaccttgacaacctccttttagcaatgaattctctgccttaataaggaagagagcatgaagaagtaaaatgttaatgtcttattctttttgaaacatcagtgggttttattcagttttatggttcaggaaaatggctgttagaccttaatggcatgtccattcatttgtaaatacaggatatttagccctgcatataaaaagtagtaattggacccttaaagcagatttcataaaatttgtcaatggcaatttgcataagtgactgtctgatttatttctcatcatttggaaacacttttgtactctggatttgagagcttggcatgttaaaaatcatttaactatctagaaagtctgtgtttctttctgtcaagactaccaatgtttccagccatttttgaggagctggccctgttaaaggccagggctgttgggaaaataaataaataggccaaggctattggtggaattctgttgtaataaaggaaatctgcagatgcagagtctgcattcatctctagcctttttttttttcctttttttttttttgtggggggatggagtcttgctctgttgcccaggctggagtgcagtagcacaatctcggcggctcactgcaacctcttttgttctgttccattgttttgtttttgtttttcttctttggggttttcaattattcatttattgactctttgtttatcttttatatactgtttttctctctaatcgttaaaaaaaatcatcaaattcttttatatcagcaaataaccaattagtgtcagattttcacagttgtctaatgtttttgtactgtttactttgtctgaacagggtcccaataaggtcccatacattgcaattggatgataagtgccttaagtccctttaaatctataggttcctcctcctcctctgttttgttccttaaaatttatctcctcctccttctctgttttgttccttaaaatttatctgtagaagaaattaagtcttttagtgtggagtttcccacagtctcaatcttgctgattctacctgtaaattggaggcagattatagatttaatcagatttaggctcatattctggcagaaagccttcataattggtggtgattgcaaatcctgtttctcttttagttatttatttttctttttctcattttattctctatgtttcttaccatgtttactatgatgtctgtttccttgttctttgtaagtcagtctttttgtcactataattgtaccttttctataattttttataaatgaaattacataatatggaatcttgtatctggtttctttctattagcataatgcttttgaaatgtgtatatcagcagttgatttcccttttgttgttaagtaatactccattgatgaatatacagtttgttgacgtgctcacaagttgggggagtttggttgttttcagtttcatctttatgataaagttgccatgaacatttgtgtatacatctttggttggacatatgtttttgattttccttggtaaataactaggaatgttattgctaggttatatggtaagcttgagaattccagatattccacatcctcaccaattttagccattcttgtcgctgtgtagtagtgtctcattttaatttgcatttccctaatgactactaattttaagcattttttaaaataagcatattggtcgttcttatatctttcacttaagtatcagctcaaatctttgccttttgttgtttttggggggagagagaggatcgtcttattatggagttgttaaagttctttgtatattctggatacaaatcctttattgcaaatattttttcccagtccatggcttgccttttcttaataatgttttcaaaaaaaaccaaaagggtgtttttgtttgtttttttgtttgaaacaaaggcttgctctgtcacccaggctggagtgcagtggcacaatcaaggcctactattgcctcaaattcctgggcttaagtgattctcccacctcagcctcctgagtagctgggactacacctgtgtaccaccacacccagctaatttttttatttgttgtagagatggggtcccactctgttgctccagttggtctcaatgtcctgggctcaagtagtcatcctgccttggcctaccaaggtatgggaaatacaggcatgagccactgcacccagtcgaaagttttcaataaagtcaggttcatcagttttttttcttcttatgacttaggctttttgtgttctaagaaatctttgcttaaccccatggttacaaagatttttttggcatgtttttaaatataagccttatagtttttgttcctacatttagttttataattcattttgagatcgtttttaaatatgttgtaaattaagagtcaatgtaaaaactttttccgtaataggtcttgaaatcagatggcctaagtcctgcaactttttttcttttcaaagcttgttttggctattcttggtcttttacatttccctgtaaattttagaatcagcttgtcagtttctacaaaaaaaatgctgagatttttattggaattgcagtgaataagtagatcaatttgagggagaattgacatctaaacaatattgagtcttctaatccattagcatagtatatctctctgtttaggtctttaatttctttttgcaatgttttataatttttttatgcacaaatcttaccttttgtcagatttaagtatttcaaatttttgatgttatagtaaatagtttttttttttttttgagacagagtttttcgcttgtcacccaggctggaatgcaatggtgtcatctctgcccactgtaacctccgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgcccttggcctcccaaagtgctgggattacaggtgtgagtcactgggcccagcagtaaatagtatttttaattttaattttttattattgctagtatatagaaatataattgatttttatatattgaacttgtttcctgcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgatgttagccataggtttttcgtggagcttgaggaagtttcattctgttcctggttttctgagttttattatgaatgggtattaaattttgccagatgcctcttctgcatttactaaaatgattatgtgaacttttttagtccattaatatgatggattacatcagttgacttttcaaatgttaaaccaaccttacattcctgggataaatcctacttgtttaggatgtgttgtctttttttgtgtattgatggagttcattggcagaaacttttttacatctatgttcatgatatatttactcttcatttctgatatgatttacttttttttattatttctttcctgagttagattggctccctttaccttttcctgttgtcttgccctcacctcacattatctggtcatcccttccccagatgttttcttttactgttgtgtggtcttccttggtagctagcattgttgtttgtttgtttgtttgttttgttttttcaagtatgttttgtttgtcattaaggaagttgtactgctgtctttccacttttttataatagggctttgaacagttgctgtgttttttaccattatgatactcatatttgaatgagttggaatttgcaggactagctattagtagacttctatagaaaaggaagctaggcgggtagttttttagactttgctcctcaagaacgtttccttctttgctctggtgtagccacagcttcttagcctctctgaatctaacttgattctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattacaggcgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaattttataaacgtcgtagtcccatcttccatcatgtggctatttagaatataaattcaatataaatttgtatcattttgtttgttatcttctaggccaattttttctttctgcttcatctttataaaattttgttttcttcttttttttccacccgaaacagggtcttgctcttttgcccaggcatggtgcagttgaggctcactgcagcctcaacctcctgggctctcaacctcctggactcaagtgatcttaccacctcagcctcctgagtaacagggaccacaggaacacaccaccacactggccaatatttgtaatttttttccagagacagggtttctctatgttgcccaagctggtcttgaactgctgggctcaagtgatccactcgcctggcctgggtctcccaaagtgttgggattacaggcatgagccaccatgcccagtctatggttttggtttttttttttttgttttttttttttttttcagacagtcttgctctgtcgcccagcctggagtgcagtggcacaatcttggctcactgcaacttccgcctcccgggttcaaacaattctcctgcttcagcctcctgagtagctaggattacaggtgcctgttacctggctaatttttgttgtatttttagtagaaatgttgtttcaccatgttggccagcctggtctcgaactcctggccttaagtgatccgcccgctgcagcctcccaaagtgctgagactacaattgtgagccactgtttccagccccagcctataaaattttatccttatgcttctcagaccatctgtcctcccacatatgtatttgttttctatttaacttcagattcagactgagtttcccatctctttaccattcttatattattaaacaagttttcctggataaaactggtagctattcattgcctgcctgaagcttagaaagtggccatgtttggctctacaacttatcctaattgtttggaatttataagccagtcaatgccacttagactagctctttcccagtgattgtgtcctatgtaagtgaaaaaaaaaggaaagtgagaattaccagtaaataatcctctggacttatcagtcaggttatcaagcctgtaaaataatttattatacttctctttacagagtagaaattggttttcgtttttgtttttgtatttttaaagacagggtgtcgctctgtcatctaggctggactgcagtgatgcagtcacaattcactgcaacctctaatgcctgggatcaagcaagtgattctcctacctcagcctccagagtagctaggactacaggcgtgtgccaccatgcccagctaatttgttttcttttattactttttttttggtggggggtgggcagtaaagacacggtctcattatattaagtgaccctcctgcctcagcctcccaaagtgctgggattacaggcgtgaaccaccacacctggcctcagggtggaaattcttaattcttctttctcccaagaattatctaaggaaagatttattaaaaatgatattcatcaaacctgccctctagtgacgttttaaagagaaggaactttcagagttatagcactagcaaagcagttctgcacttaagaatattttctccttcctcaaattcatttaatggaaaacagaaaattatgatgtaaccagtgttatagcaaattggcattgagcaccttgattcctgctatcccttttatttaattgtattaaaaattttgtttcctcacctgtaatcccagcactttgggaggccaaggtgaccaaattgcttgagctcaggagttcgagaccagcctggccaacacggtgaaaccccatctctactaaaaatacaaaaattagcatggcatgatggtgcatgcctctagtcccagctacctgggggactcatgtgcgaggatcacttaaacctggaagttgagggctgtggtgagctgagctgaaatcatgccactttgctccagcctgggtgacagaatgagaccctatctccaaaaaaaaaaaaaagtttcctttaaatggagcaaaatgccattaaaacccaaagatatggcaaaatcctgcctctttttttttttttttttttttttttgagatggagtttcactcttattgaccaggctggagtgcaatggtgcgatctcggctcactacaacctccgcctcccgagttcaagcgattctcctgcctcagcctcccaagtagctgggattacaggcacccgccaccacgcccggctaatgttttgtatttttagtagagacagggtttcaccatgttggccaggctggttttgaactgctgacctcaggtgattcacccacctcagcctcccaaaatgctgggattacaggcatgagccaccatgcccagcctaaattctgcctcttgattaacctctgtgatttatgtatcctctcttctagctttggtgtcatccccagcactcctctggccatccatacaccactgatgccaaaccagagcattgatgtctccctgcctctcaataccttgggcccagtcatgaagatggaacctctgaataacctccaggtcagagatttacttcactcaggtggtacaagttaatatcttgacaattattattattattattatttttaaagacacagtcttactctgttgcccaggctggagtgtagtggtgcgatcttggctcactgcaacctctgcctcctgggttcaaatggtgctcctgcctcagcctcccaagtagctgggattacaggcacaagccaccacgcctggctaatttctgtatttttagtagagatggggtttcaccatgttggccaggctggtctcgaactcctgacctcgagtaatctgcccacatggacctcccaaagtgctggaattacaggcatgagccaccgcgcctcgcccaatttttcatttacatgtaaaaaagtccctctttcttccttaggtttgagttagtcatggaatcggatttgaaataaatctttgtggacgagagttttatgttttgttgttaagaaaaacaaaagtcatgcatgacatagatattcattcttttactcaacaaacacttagaaacttttttcttaacttcttatttgtaaaccttttttccttaagacttttatagcaaaatttgaatgtcattaatataagaagagatttatatggaggttatcattgaacattggaccacaggtagctaggctgtttggatttaaatgccccattagcacctatctatgataagtataacagcatcttagaagaattttatgtggtctacaagagcctctttatcttgaaaatgtcgaattttttagaatgcttgggtgtcagcttagagtttcattcagttttcacctacctcgaagtttcctttgaaatataaaccttctgggcttcaggcaacatgaaggcagagcagtaagctcataagtcagaactgtagcaaccctggaggttgctagcggttatggttttaatgttcacaagaacaggaagaaagccttgggccacccagaaatggggaactgtaatcgatccctgcataaagcagagaccctggaagggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactatgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttggctcagacaagaagaataaagcaaggattactatgcagatggaattggctgttactatgatgacagtaatgtgttaaggggcttttccagcacaggatcctgaagaaacttaacccaaatctacatctgttcccttttcattgaaatctaacctcccattggccacagagcctcaagcctaatatttgaggacagtcagcatgcacgcaagaatgctttacctcataagtaggaaagagaatttgggtcacagaaaccagggcaaattttctgctcttaaaatgaaaagaaaaaaaagaaaagaaacagtaaacaaattaatgaatgtcagtttactttcctgttggcatttccatttgactaactcctgaacaggaaccctcacaagagaagttgaatcttagtccaaccctttcctcaaaagtattgatgtgatattagaactagcaagttttaattttcataaacctgatattataagaagcaaactttaaatttttccatctatagttaactactgatttttcaagtttcccacatggattctcttcttttggggatgtcataattgtggctattttctcattaattggcatttcccaatggatatgataaacaaaacttgaaaagagaaaaactttttccccctgtgagcagctctacttagtgtatgctggtgagagttggaactaatgtaatggctagcttagggatgtgtagggtactttagatttcagcttccattctgcccttttccccgtatgaacaagaagaaaatcaaaacatcattccaacaaggttaaactatatatacatccagataaagccaggtaaagattgatctagcttttaaatatatttgtataatgtttagattcaagagctcatgtgggaaaattagtatttttctagtactacagaccataaaattgggaaaaaaaaatgttggggattgaggaaatgaaattttgaattccatgtggattttagctattttggctaatttaatatcaatgtgtagaacaattaaatcaagcccagctgccagaactgtagtataaaacttattataaaaacttttcatcagaacactcattaaactacttattggcttatagactatttgaaacactatttaaaaatttaaaagataccattcattcttttttttttctttgagatggagtttcattcttgtcacccaggctcgagtgcaatggtgcaatcttggctcactgcaacctccgcctcccaggttcaagcgattctccagccttagcctctgagtagctgggattacaggcacctgccaccacacccagctaatttttgtatttttagtagagacggggtttcaccaatgttagccacgctggtttcgaactcctgacctcaggtgatccacctgcctctgcctcccaaagtgctgggattacaggcgtgagctgccatgccctgcctattcattcttaaaatgtaaaatacattatgccttaaatatgggaattaaatacctagtagagatttgaacctggaagaatttttctactatactgacatcgactgtaaaagcttttgtgaatcagcttataaacattatacaaagtaaagttaagcttgctcctactgggagcctttcttgagtttatttatatcacgtaattatattccttaaaaagagaattgattctctctgtttaaatacagcagaaaccttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcaagttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggctaacacggtgaaaccccgtctctactaaaaatgcaaaaaaaattagtcaggcatggtggcaggtgcctgtagtcccagctaattgggaggctgaggcaggagaatggcgtgagaatggcgtgaacccgggaggcggagcttgcagtgagccgagatcgcgccactgcactccagcctgggtgacagagcgagactccgtctcaaaaagaaaagaaaagaaaaacccagtcctgagacttttctccctaacaagacctccaatatctcctcccacaaagccaatttcgttcacctcttttgataattacctaaataacatgctcatattgggactcctggatttttatttatttattttttttgagatagggtctcactctgtcacccaggctgatggtgcagtcatgagacactgcagccttcacctcctgggctcaagcaatcctcccacctcagcctcccgaatagctgggaccacaggagcacaccactacacccagctaatttatattttttaaaattttttgtagagacggggtctctccatgttgcctaggctggtctcaaattcctgcggtcaagcaatcctcccaccttgacctcccaaagcactgggattacaggtgcgagccaccacacccagctggatttttctgttttagatattcctgtacatgtccccactcactgccatcatctacatacttttcatgttcccattttttctgacagaactatcttaaaatttacttaaatcagtgttcaatgtttacatcaatttttttttttaagagataaaatcttgctcagtcacccgggctgaagtgcagtagtataatcatggctcattgcagcctcaaactcctaggctcaagcgatcctgctaccttaggagaatctcaagtagctgggactacaggtgtgtgtcaccacgcctagctaattttttatttttatgtagagatggggtctcactgtgttgcccaggctggtctgaaattcctgggctcaagtgatcctcctgcctcagcttcctaaagtgctggaattacaggtatgagcctccacaccctgcccagtgtttacattattatgactgcatatattctttgaagctgagccatatattaaagtgatttttcctcaataaaactttttgtagataattggagttaatacccatttatgttggtgtttttaactgtaattcaatcccaaattccattgagatcagacccttcaaagtatactattggtttccctttcttaaagtctcttctagactgatttacttgaatgcctggaacatagctgtcttcctgggacctcctttcatcttaaccctggagattcattcccttcatcagctctctcctactcaggatctcctgttatagtgtccttttcttggtttactccctcttttgatgaaacacattttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtcttttcacccatcatgctgggtactcattgggttctttaaaaccggaaactcatgtccttcaattctaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaatacaaaaattagccaggcatggtggcacacgcctatagtcccagctaatcgggaagctgaagtaggagaattgcttgagccagggaggcagaggttgcagtgagttgagattacgccactgcactccagcctgcgtgacagaacgagccacaagcctttatctcaaaaagaaaagaaaaacacttttttatgaaacatttttaacattgcagaagtaaacagaatagtataacgagcccctgtgtacccatcatccagcttcaataattatccatggttaatatcatttatacccctttccataaccctactctattgtttgaaacaaatcccagacatttatatcacttaatctgtaagtattttagtatgtctcgtattttgtttgtttgagatggagtctcgctgtgccgcccaggctggagtgcagtggtgcaatctcagctcactgcaacctctgcctcccgggttcaagtgattctcttgcctcggcctcccgagtagctgggattacaggcacgtgccaccatacctagctaatttttgtatttttagtagagacggggtttcaccatgttggccaggctggtctcggattcctgaccttgggtgatccgcccttgtgggattacaggtatgagctaccacccccagctcagtatgtgtctttaaaataggtctcttttaaaaaatttaactacaataactattctcacaacttaaaaaattagcaagaattccttaatatcacatatcgaatcaatgttcagattttgtcataattttttttgttttattatttgtgtttgaatcagtaaagtgcacatattatggtgggttgatagctcttaagtctctttagctacactgtttaatatgatagccactagccacatgtggctatgtacattgaaattaaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgtatgtagttgtttttcttgtatttctctggcttggagctcactgagcttggatctgcaagttgatagttttccccaattttggaaatgttttgtcattcttcagattttttttctgcctcattatgtctcttctctccttctagaactccagttacatatgtgttagactactggatatcatccctcagatcactgaggctgctttttttaaatttaatctttttttctctccgttcttcagactggataattcctattgatctgtcttcatgtacactgcttctttcttctataggcaacaaccttctgttaaactaatccagagcattttcatttcagatattgtactttttaattctaggatttccatttgattttttgctgaattttcctcactgggctggctcaattctttccaaagttatctttaagtctctgtctacgatagaaaggctttctgcaagccttgtggggagctaaattgggaaagagggctggagagtcttagcattcagtatgcattaattcatttaattcaccacccctcagccatgtctggcttttacttctaagtgccatctattttatcctctctaaaagaatcaatcttcagttttgtgcagggcctagagacctaagagctgtccagcagtatagaatcggggttggtatctagaaatcctattgacatcttaatcctctcgtttttaacactcccctcctctccccaccatacagttccagaggtgctaccagtcctaagcctttgagaattctgtggtggtattgctaatccatctgttttccaggtaccaagtttttgttgctgttatatctttttgttagtatctctatgaatttataccttgaaaattttttattttcccttagttatggcagaactttttccaggagaaaggaaacttaaatgtgatttttcagtctactgcctctgcctagaggtctgatagcaccttaacattttttctttccttcctgcgatacaactttataattaggaaccttagaggtgaacctgtggagaaagaattgaccctttcccatatatagtttttgttgtccctgtctttattgcctttaaatctcacataaacattgtcgaataagaggctgaatattaattagagaaaagaaatagacacaatgtctcttttttttttctttgaatatctttctaaaacaaggcaatattcatcagtctgttcatgtaacctttgattagggcagaaagtgctgaagacactagctgcaaaggacacgatcttacagtcctgtttattcatgtcttaagatcattgtcagccaaattttgctggtatatggctctgaggaaattctgtcccttgctactcctacatgtagttccagcctgtgagacagtcagttgcagatggtgcttgtccctgatatttcatgtcttgcatatgtccgttcacactcagaaagcccacagctatagctattgtaccagaaaaactggtagacgcttccaagcggaagaccttttcagcgctcccatcaaatgaagcaaaccagcttggcatttgctgacgtttcttgactgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattcccacgtcagacagttggatccagcgttggatctactatccaaatgatccctgtagacctaaaaatattccacctaaaatattccataagcagtatgtaggtactggagtcttcattatgaaagattaaaacattttgctgtcaaaaaataaaatagaaaattacttactgtgattgctacttccagtttgacatattcttcatgtcccatcaggactataaacatattatttaatctcatctgagaaattcaatatattatgtattagatattccttttttgctagattgtccttagtgagaacactcctttatctttttttatcaagataatcgagagtctactaagcagtatcttttgtctttctgtaaccagcactcaactactggtttctgggatcttttagcagtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagatttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtttcaaaccctatctgtttttgatggaattccctctttcttggcagtgatgggaaaatcagtgtgtacatgaataccaccagtgatttgctactctaaatgacccattctgtcttcataaaaccctgttacggagttgtttatttggcgtttttttatgtttgttttctttggcgcggggcggtggggggaggggcggtaaattggagtctcactctgttgttgcccaggctggagtacaatggtgtgatctcagctcactacaacctctgcctctcaggttcaagtgatcctcctccctcagcctcctaagtagctgggattgcaggtgcctgccaccacgctcagctaattttttggatttttagtagagatgaggttttttcaccatgttggccaggatggtctcaaactcttgacctcaagtaatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccctggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttttacccctggattgaaaaatcagttatgttcattgataccaattactgcctattattactgaagtttgttcttttattgaatttctactaggtcttctatgacatattaaattagagtggaattttaatcactttaactgatagttttctagtcttgccttcacgattttttgattcaatacagtatgtattaaatgcttttgtttgttttttttcagtcagggtcttgctcaacttcccaagttggagttcaggggcacaaacatagctcactgcatcctcaacctcctggactcaagtgatcttcccaccttagcctcccaagtagctgggaatacaggtacatgccatcacacctagctgacttttttttttttttaattttttaattttttgtagagttgaggtctggctatgtttcccaggctggtcttgaagtcctgggctcaagccatccacctgccttggcctcccaaagtgctgggattacaggcatgagccaccgcacccagcctaaatgtatttttaaagtttaacagtaaacccaggctgagcgccatggctcacacctgtaatcccagaactttgggaggttgaggcagttggatcacttgaggtcaggagttcgagaccagcctggccaacatggcaaaactctgtctctgtctctacaaaaatacaaaaaagttagctgggcatggtggcacacgcctgtaattccagctactcaggaggctgagacagaagaatcgcttgaacccaggaggcggaggttgcagtgagccgagattgtgctgttgcactccagcctggggaacagagcaagacttcatctcaaaaacaaaaacaaaacaaaacaaaaacccagtaagccctacatagcaaataatagctcaagttgtgcctctgcccccctcttcccacccctgactattaacataaacaatattcgaagatgagacagcagcaaccaagggcacatcagccagtacatgtagctgtgtagctatcattaaagggaaaaagaaagactggtccctttcggcttatctgtcaggcaggctgaaaggcctgtgaaattattgctgactgtttctggcaactggaactatatagagtaattctattgtaggctgctagaagaggagaggattaggggccagtaagatttctgaagagtaactgggttgatcaatatagtatcacaggtgggttatacattggcagaaagcagtcacatatacatttgctgtaagttctggatttattttatttaacttataaaactttcaaaatgagggagctacccaggagtaggaacagatgcagtgtatcttagcatgattttcccttgatcctgggttccctgtgaggcacacagctgccagtgacataggtatgtcactggcatacctatgtcagtgactttcacatactggtgaaagttgcttaattcttgctataccactggcctgttccattcaagtaaccctcaggtaagttacctgttatactcagatatctaacttatagcaaatgtatatgtgactgctttctgccagtgtataacctccctgtgatactattctgaccaatcttttttattggcccctaatcctctccacttctagcagcctacaacagaattactctatatagtttcagttgccagaaacagccagcaataatttcacaggcctttcagcttgcctgagagataagccgaaaggcaccagtctttccttttccctttaatgatagctacacagctacatgtactggctgatatgcccttggttgccgttgtctcatctttgaatactatttatgttaatagtgggggtggggtggggctgaaggacaacttgagctatttgccaagtagggtttactgttaaactcaggtaaccatgagtataactggccagtgctatagcaagaattaagcaactttcatctgcccactcggaagagcttgcattaacagtttctaagcagaaaaggcaaaatcctaccaaaggtctccaagaccttgggtgatctagctatgcctttccctccctcctttcctcattaacttcatctgctactcctcctcttcactatagccattctggtctcctcacttatcttagaatagggtatgctgccacctcatgaccttttaattgactattgtccttgtctggaatgtgccttctcctagtctccatatcgtatagcttacttacttactttaggtttttactaaagtagtacccaaaaaaagagaatagaatgatagttaccaaaggatgggaggtgaggggaatgaagagaagtaggttaatggatacaaacatacagttaggtagaaggaataagttctttttttttttttttttttaagtctcactctgttgcccaggctggagtcaatggtgccatcttggctcactgcaaccttcgcctcccaggttcagcctcccgagtagctgattacgggtgcccgccaccacacccggctaatttttttatttttattggagacaggagtttcgtcatgttggccaggctggtctcgaacaactaacctcaagtgatctgcccacctcagctttccaaagtgctgggattacaggcctgagccaccgcacgcctggctaaatagtacctttttaataaaagattttctcacttcactcccagtactaccaatctcccttatttttaccccatagcatttcattatattttaattactacttaattatttattaccacctcctgctcctctcctactagaatgcaaattccaaaggaacagcagtttttgtctatgtttttcccaccactgctatgtctcccagggcctggaacgatgtctggcacacagtaggtgctagataaatatttgttgttgaatgagtctttttgctttcatttaggaaagtattaaccagcatcagattcatctagttcttgaaccaaactaagcaaggctatctcttcatcttaacaaacagagtatccctaaacacagcctctgcctgttgtttctcagcagccttgcgttctatcctctgactctgatacaatacccttttatctggataggtctggtcctggtcccaagtttaatctgaagactacaatcacaaattcattttctctcaagtaggcagagcaaatattagaagctgttgcttccttgatattaggaaaggcaagatcacagcacattaatggaccctgttttcaaaactggagatgactaggaacatagcacatgttaactgtgctcacattttgggaattttttctgttgctaacttacgtctgtatgtctctttaaaataaaaccaaattgccaccatgagactattaaattattatcctaaagagccttagactattttggttaatttaatatttctagagtaaatttggaagctcaaaatcagagtaaatgaggaagttcaaggatgctcttacaagtgttttggagcctcagggaaaaccgaaatcatttagatgcccgacaggaaatggtgctgagcaagccctttttactgtgaaaacagaagaaccctgtctttttcctaatcctgatagacacaaaagtgtaaggaggcaaactttaaaagcaagtgcctgctgggcacggtggctcacgcctgtaatcccagcactttgggaggctgaggcggcagatcacttgaggtcaggagttcaagaccagcctggccaacatggcgaaaccccatctctaccaaaaatacaaaaattagccgggtgtagtggcatgcgcctgtagtcccagctactcgggaggctgaggcaggaaaatcacaaactcaggaggcagaggctgcagtgagccgagatcccaccactgcactccagcctgggtgacagagcaagactccgtctcaaaagctagggcaaaaaagttgtcttttagcaatagatattcattatttctctttacttttaagaaaacaattttttcaggtattcaaaacagtcttttgcctttaaatggaaaaaaaagtttttaaaaaagggtagtcatctagcacttttcaatatcaggtttttctttacttgctattagaaagtttactttggtgggaaatcggtgtgataaggagtgaaaagactgagacacataaactgaaattcaactttggaaatgaatttttttcactcagtgagacttaaaaaatgaaccacccagctgcactggattttgtgttggaactttgagggtgtttttttttgttttgttttgttttttggagacagcattctcacactgtctcccaggcaggagtgcagtggcgtgatcacagcttactgcagccttgacctcccagactcaagcaattgtctcacctcaacctgaccagtagctgggactgtaggtgtgcaccaccatgcctggctaattttttatttttatttttgtaaagatgaaatctcaccatgttgcccaggctggtctgaaactcctgggctcaagcagtcttctgccttggcctcccaaattgctgggatcacagacaggtgtgagccatgcctggcctccacagtttagatggctgcagtgatggctatgggtgggctactttttctatcctccacaaaggtagtctttcatgaaaattgtgacctactcaccctttttccaaatggctttacaggggcagggtgggggattctcttttaaagaagtacttgagaatctatttcagttgcaaaatagttaacaaaatttgatttgagtagttctgaccttgctgtgctttggactcccatttgacagccctgaaggttcgtcattctaatttactcctgcccaaatggtgattttgacagtttaatccaaagtcttttaaagcaatgtctattcataccactttacaatctttatctaatctttagtgttctgaagatttaatttgctgacatttctaatttatggtctaaattatttgagagttttttgagattgagattaagcagatctcatagcagaatgggtactacaggagaagtcatagtatttcagtttcagtgtcttttggtttctgttggcttcctttcgaatcaaggctttactaagagagattggctcttaggagctcattgcctttttaaagcccaataattatatgtgctactagaggatttacaattttagagatcatctggagggctctgttcaaagctttcatttctggttctgagaactgtttaaatatggaaacttcaaacgctgaagtgcgtattagggacatggaaccactgcctaatctgtcaaattttccctataaagggttccactgttcacatactcttaacgaacaatgtcctaatgtctcctgagaataaatcagtatggctttatactcaggatgaacagcagtttggtaccatttgaggcctcctcagctatcatgtaatacccctgatctattgggtggactgagaaagaatatgggaagagagttcttgtttgaatcctagccttggaagtgaactaaagacgctgtccagtttaaaatggaattagcactggaaggaaagtcaattgacatttcctgtggttcattactctttctgctatgtttttaactctatcagatactgtctaatatcataaataggcctttctgttttgtcagggtctctgagaattcccagataattcattggtcaatagagtttgaaatgctatttaaactttgggtcaccaagcacagtggctcatgcctgtgtaatcccagcactttgggaggtcaaggtgggaggatcgcttggggtccaggagtttgagactagcctgggcaacatagtaagactagtatgtctagtctattccagtatgtagactagtgtctacaaaaataacagagttagccaagcatggtggcacatgcgtgtagtttcagctactcacgaggctgagatgggaggatcacttgagcccaggaggtcaaggctgcagtgagctgtgattatgcctccacactccagcctgggtgacagagcaagaccctgtatcaaaaaagaaattaaaataaataaaataaacttaagatggtagataccttttggcgttgattagaaatgcagaactacatgttaatttaactccagcacctagcagaaacggccgcttctgcttgagtctcagatgatatatatcacatagttggagtaagtaccattaaaaacctgtcactccgagccattcccctaggatctgttgactaggttgtgtggtacttaaaacacatctgaatcatcattcctcagagaactggagatggttgacgtcactgcctggtcctagcttggaccagcctgcatataatcattccaaaagctaaaaggagaagagaaataaaagaaaaaaataattcttcagaaatgtggaaaggtcacaagtgacgttatggaagagcagatgatataatctcaaaggcgagccctgtactatttcacttggttttccttgtggcagtgcctcctttggttacctgtggtgagaggtggggtaagaggcctcatttgccagagttcagactgagttcatgttatacctttttatagtacttttgagtatactggtacaaggttagaatattaatttagcctgttcatctccagctgtcccaccataaagagattgtagctcctgcagcaggctttctatactatggaaagaaactaattgctggttacaggcttaagctgacaggttgttctttccttagcagcctcttaaagtaactttaaacaatcattgttattattaagcatttatagcctgcttttgtgttttcaaagtgccttataatttctgtttgctttcctattgatgtccctaaaaagcaagttaatattgttatggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatgatagtctacttcatattatacccctaatcttgacccagccccatgcctccttcacagtatgtgtccattctttcctcttctattacgggaaatacactagaaaaatgtgagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccatagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtagggaggacagtggaaaaatataaaagaagtattgggacagtggaaaaatataaactggagttggaggttgggtggtacagttttacaaaaatatgttggtcatggaagacctatctgaaaagataatatttggttaaagcaaagactcaaaggagacagggaaagaatcatggatttctggaggaagagcattgtagacagaagaaacagcaaatgcaaaaagccatgaagtaggagtgtacctgctatgtgcaaggaaggaacaacaggctcctgcagctggattagagctagcaaggaggagagtattagcacgacctcagagaggttggaggagttggattataggcaattgcaacttggtttttattctgagtgagatggaaaggtttgagcagagaaatatttatgagctgacctacattttaagatcactctggctgctatgttgagcatatactggggaagctaggtgctgtgaagggaatgtatagggggatgtggctggaagactagtggagaggcagagagactgttaaaggctttgcagaatcccatagtagttaccgagtttggaaagacagcaggaggttgtatttggaggtggggaggggagattaagagtttggttttaccacaatgagatactatctcacaccagttggaatggctattattaaaaaaatttttgaaaataacagatgctggtgaggttgtagagaaaaacacaacacttatacactattgaagagcatgtaaattaattcaacccttgtggaagacagtggtgattcctcaaagacctaaaaatgggccgggcgcggtggctcacgcctgtaatcccagcactttgggaggccgaggcaggtggatcatgaggtcaggagatcgagaccatcctggccaacacggtgaaaccccatctctactaaaaatacaaaaaattagccgggcgtggtggccagcgcctgtagtcccagctaggctgaggcaggagaatggcgtgaacctgggaggcggagcttgcagtgagccgagattgcgccactgcactccagcctgggtgacagagccagactccatctcaaaaaaaaaaaaaaaaaagacctaaaaatggaaataccactcagcaatcccattactggatatatacccaaaagaatacaagtcattctatcataaagacacatgcacacctatgttcattgcagcactattcacaatagcaaagacatggcatcaacctaaatgcccatcagtgatagactggataaataaaatgtggtacatgtataccgtggaatactatgcacccataaaaaagaatgagatcatgtcctttgcaggagcatagatggagctggaggctattatccttagcaaactaacacaggaacataaaaccaaataccacatgttctgacttgtaagtgggagctaaacgatgagaacacatggacacaaagaggggaatagcacacactggggtctgctagagggtggagggtgggagaagggagaggatcaggaaaaataactaatgggtactaggcttaatagctgggtgataaaataagctgtacagcaaatctgatgacacaagtttacctatgtaacaagcctgcacatgtacccctgaacttgaaataaaagttaaattttttaaaaaagagttcagttttagacatattctttttgagcaacctattatccaagtgaagatattaagtaggcagttggttatatatgtgatcattgatttccctcaagcaatctaggcatgatgttatagcttttggaaaatagtttagaacttgtctggattatatcttcctactatctctacctgttgggatagtgaatttttaaataagaaaacaagaaactgtctttctcttttcctgtctccctccaacaacaatatcatgctctttaaagctgatttagttatatttaagagcaatcagcatcaggattggaattaaactggcttcatactgtgtttttcccttggttcttttttaacacccaaaatatgattggcatatccttggaggacctagcattctttgggttgtgatccactacctgtgttgtcctttcttagcatgtagatattatttaactcagtgatttgaaaccaaaagaacccatacatcatcccatccccccattcctgcctcattgagaatcagtgtgcctaatcagagatgttgctgatgggattctgttatgtatatgaatgatatggaggtagaaaaaatgttgagaaacacagtgtttcatttttatttgttcaacatcttccacttattttcatgcaacaaatattttttgaggtagtcaatatgctagcgaagatgagagacagaccctccactcaaggagctcattgtattataggtgagccggaagtaagccattattatatgctatcatagaattgtatgcgttgggtgctgtggggaggtgttagagctttctgggaagtgttaatcttgaactgaaccttaaggttaaataggtattttccagacagtgctaagcttaaggagaagaaaatattaagcagaaagaacaacatataggctgggtgcggtggctcacgcctgtaattccagccctttgggaggctgaggtgggcagatcacgaggtcaggaattcgagaccagcctgaccaacatggtgaaaccccgtctctactaaaaatacaaaaattaggtggacgtggtggcacacgcctgtaatcccagctactcaggaggctgaggcaggagaatcgcttgaacccggggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcctatgttactgaaatgaacccagttctagcctagagtgaaaatatgagagctgcaaaatacagattttgaaaagctaatgtaaaagagatgaactgcttcccccaatgaatgacctgtgtagttgatcctataaagagatgacaatttaccaaggcagtagcaaaaggaatcattaagctaacaatctgccgataagccttttaaaaagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctctgttgcccaggctggagtgcagtggtgcaatctcagctcactgcagcctctgcctcctgggttcaactgattctcccacttcagcctcctgagtagctgggactacaggtgcatgccaccacgcccagctaatttttgcatttttagtagagatggaattttgccttgttggccaggctggtctcaaactcctcacctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgtagggtagggcctggcatctgttttgaaaagcctttccagatgattctgatacaggtcttcagttaagaaccactaatattatcctctagagaatggggatactactttatagtcaaagataatcacttgcatttcacatgagacctttacatgacccaccattagcctacccccatcaccccagttttcacttttttttttttgaggcagttcactcttgtcacccaggccagagtgcaatggcacaatctcggctcactgcaacctctgcctcccgggttcaagtgattctcctgcctcagcctcccaagtagctgggattacaggtgcccgccaccacacccaactaatatatatatatatttttgtatttttagtagagatggggtttcaccatctggccaggctggtctcgaactcctgacctcaggtgatctgcctgcctcagcttcccaaagtgctgggcttacaggcatgagccaccacacccggccccagttttcacttctaaatgttctttacagagcctagcgctgtctcaagatcttcttggtgcccttatttgaaataagaattctcctctcttacctgccaagtaccagatgagttagaaaatactctttcccggaagcccacggctggcatcaatctttgaaagtagtgctctggtacatcccttgttgttgttgttgttgttgttttgttttttgttgttgagacggagtcttgctctgtcaccaggctggagtgcagtgacacgatttcggctcactgcagccttgcctcccaggttcaagcgattcttctgcctcagcctcctgagtagctgggactccaggcatgtgccaccacacctggctaattttttgtattttagtagagacagggtttcaccatgttggccaggatggtctcggtctcctgacctcgtgatctgcctgccttggcctcccaaagtgctgggattacaggcgtgagccaccgtgcccggcttcccccctttttttttttttttgacagagtcttgctttgtcacccaggctggagtgcggtggcgctatctcagctcactgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctctagtacatcctaaagaatgcctttagttcctctttcctgacattactctgcttaaattccccagattcaagctttttgagaatcctatctcagcattttgggcatcaggccatgttatatataggtcacaaactcctagccttgttagttgacaggttaaaagcaaggagaataattggatggacacttctgggagagagaacgcaaatattatggagaagggaatacaggcaccatttaaagtaaggaaggtaagttgatactaaatgtagaaggactggaagtactttagaaagaggatatttggatctcatagccacagttttaagaggtcagtatgctgttgaagtgtagacatttgccataaaagacagagagtgagaatagtgtactagataagcactttttaactctgtttttagagcaaaatgagaaagaaacaggtatagttactgatcatagaacttgctcagataaatgttttcctacagcgctaagagcatagataggaaagtcattagtgacagaaaccagtgggaggtggtgacttagagcaagtctcctcctactccctcttcttacagtataagggccttatgatgtgctgctgtgcaatctgcctgttcctgaatgtatataccaatcagtgttgccctgaataaaagtacttactgtagctttaaaaaaaaaaaacaaacaaacaggatgctctgaattaagcaggctatggtagaatcatagtcgagaagtttgtattgtgagaagaaaatttatttatttgctcgcttaaaggttttttgttcttatagtcatcaggtttaccagtgttgggccaaacaagctttttccaaccataagacctgggaaataaggttttataaaagaaacaactttaaaactgatatttaaaaaaataaaaaataagagatagtatggcactagttattgtggggagaaataaaaatcaaggtttagcgtcaagtttctgtttgaatcgtaattcttctgtgtactagctacatgactctggatgttacttagtctttctaaacctgagtttcattatctgcgaaatgagaggggaatgatatctactttgtttgagatcattatagtgtgagttagaaataatatcattaataggtaacttagtaagtggtagcagctactattaataatcatagagaaaaaaatcacagactagattattcctggtatacaagttgtgccttgaagacaggccttctggaaggaggtagagttgcaggttgtcacagttctatgacaatggagtaagtaagggtgtgctttgcagtatatgggccagtttgtttgatttggggagacctgcactgagagaaagaggaaggaaatagggaggcctatttctagacacagcgctgttcttttcctcctacctggctccctgcgatgtcctcatttgaccttgttgctttcctggcaggtggctgtgaaaaacaatatcgatgtcttctacttcagctgcctcatcccactcaatgtgctttttgtagaagatggcaaaatgggtaagtaccttcctgcctgtcctgctgaatatacctttgcccttcctgtgcatgtcaggcagagcatagccccagaagttttgagttattttgaggttaaaaaaaaatgggttaaggatattctaaagctcttaataattgctcattatttattctcctgtgtcacaattgttcttgctctgccattggtctctaaatcacagtgcccaatatctgaataatccagtcaccccaggatacagaataagaggtttggggaccaggtaaatatggatttgaatctcagctctgctatttatttgctgtgtgactggtcaaggtgataaactttttggaacttccgcttccaaatttgcagtgtagataatttttataattatttcatgagataatacatgtaaatttagcactttactctgtactaagttcatactgcctcaagctaagaattcagtaatttgtaataaaccgtcagaactcccgatgtgcctattgacatttctctcttcccttatttatgaatcacaatctaataaaactggcttatattggtgcatattaaactatgttggcacttaattgatttgattcttacaatagctcttggagtaggcaggacagatgtaattatagataaagaaattaaggctcagaaaggtcataagtcaccaaaataggaaaacaagggagccaaaatgaaaccctagatatagactcttttccaattatcctagtgttactgatgacggattaattgatctgaagtatagcacttttgtagagctcagcattggctccattcccagcctgctgctagctgtattgcaagagccagcatgccaaaggaaaaatgatgcaaggcatcgaaaatcagaatactgacagcttatgcacatccatccttcccctctgctttcccatacagagcgccaggtcttccttgcaacatggaaggatattcccaatgaaaatgaacttcagtttcagattaaggaatgtcatttaaatgctggtgagtaatatactctaaatttcagtttcatcttagtaaatcaaattagatatttgaaattttaatctttcttttgcctacccttttatcctcccccgtatctactatgtttctagtgggtatatatggtagatgcattactttgcaaacctctgtttaaaaacgtgatatgttttgatgtaggtactagattacttacaagctaacatttaagaaacaagctagaatcgacccatctacccatttcttcactaaagatgtgttagttctgttacttaaacatcctaataatcaaaaactgaagtggcacttgagaacatgcactcccttagtaattgaaaggaccattttcttcttttatatcaatttttggtgttggaggaaggttaactttctttcttagattctgtacttagaaccctgtgtttataatgaaataatgtatcatcattagtgaaagcctcgttgggccaagtatggtggctcataccagtaatcccagcactttggaaggccaagatggcaggatctcttgagtccagttcaagaccagcctggacaacatagtgagaccccatctctataaaagaaaaaaaagcctagttggtaaccttttactacactgccctgtgccacctttcatatgatgatactaacctctttaatcaccattaaagagctccgtactctttcatagttaactttgttactgtaaaagaacatgaaaggggtatcccaagaagagaaacaatagcagctattagtcccttgggctgtgtttctctgaaggatttctcaggaatgaaaggagccctaagttatttagagtcctgcctttgtttcactgttgctctctctttctctttagagctctttctttctctccttttgaagttagtactaggctttgtgagtttgaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacacggcagcacagaaagcaaaaaaaaaaaaaaacacacacacacacaaaataatgccttctcattccagcttcccccaccccgctccccggcccaagatggagtctcgctccattgcccaggctggagtgcagtggcacaatctcggctcactgcaagctccgcctcccgggttcatgccattctcctgcctcagcctccagagtagctgggactacaggcgccagccaccacacccggctaatttttttgtatttttttaatagagacggggtttcaccctgttagccaggatgttcttgatctcctgaccttgtgatccgcccgcctcggcctcccaaagtgctgggattacaggcatgagccactgcacccagcccagctttttaattttagttttttatggctctatgtaatattcatcttctgtgttcagatgaatcttatagggcttttgaaatccaacatcatagtgatcagctttatcctgtgatacctcttttaaatgtgatgctcctataggccctctctgagacattcaggagactgaagccctcctggaaccctcagaataaaagacattcagacaggcatctttgcatatagaaacttcaggcagatgtttgcctctgataattgtttcacgtctctggagctcttggagaggtgtttgaagcatggtcttctgtaatttccatcataataattaattgtttcaattaattcagtaataattgatttttttcattttgtgtcatatttgaagaagatgacagtgtcatctttccctcactttgaggctcactggtggatcctattagaggagccacctctgtacccagctaggaagagaccaggcccctggttatattcacctttgtgggagttggttcaatggcaacatttcaaatagaatgttcctcagaacacttttcccttatgaaaaagggttttgggccgggcacagtggctcatgcctgtaatcccagcactttgggaggccgaggtgggcagatcacgaggtcaggagatcgagaccatcctggctaacatggtgaaaccctgtctctactaaaaatacaaaaaattagccaggcgtggtggcgggcacctgtggtctcagctactcgggaggctgaggcaggagaatcagcttggatccaggaggcggagcttgcagtgagccaagatcgcaccactgcactccagcctgggtgacagagcgagactccgtctcaaaaaaaaaataaaaataaaaataaaacaaagaaaaaaagcgttttgttatccatgaaagttgaaaaatacagcatatgctaggcttcacctggaaattgccattgcacgttagcagactaaaagttctgagaagtgctatactgaagaaacctatttaactcagtgttaactgaacttatttggccttggaatttaaaatcacaaaatacttattagtaacatcatgtggaccaccagtattccttgaacatgatctggaaaacactctccgagagagaacagagatagaccagagtgattggaaagcaggttttgtttcagacatgttcagtatgaaagggacatggttgttcaaaaaagaaaatagaagttggggtgactgaggactttggtctgtcaaaataacagagaagaaaaaatcctcctgcttttagactggagttttgaactcttattgcacctcggcatgtttttgtgatcttatcaaagaggaagtgtctggcatttctcctagtggggctgtgccctttgatgtcgtttctcagagcaaattcagttttgatcaattctgtcatggcctcacgccaatcgctccatgctgtaggtgctccaaataccaatgaatcagattccagtgatacactgctctgtggccatgccgcacatgaaacataggggaaaacagtcattgcattttctccaggagtccaaggccaacattttcccacattaaatcactgctagtcttgcaagaccacttcctgcaactaatcctttccagctcttcctttgagtccacccccaggtctggagtgccctggcctttagatttccttccagtctcgagggctctattaacatgaacgtttttggctttagtgccttctgattcaacaccctgggtctagctgagagctaaaaataccatcctttccagctgatctgccctaatcacaatagcaccaacactttaaatagcttttctgtgctagcatagacatttgacagatggaactaacactctgagggctacaggaagtcacaggcttaaaggacttaaccaacttagcactgagctttactttgctctttcatgtctttctagagaataaagaaagagaccctcttcccaagtcttaataattaatcagatcttaagagaaaagtgtatggtgggagtgcttatgatgccgctaattgtgttaagtactagaaaatgttagatcagaaagctgctaacagaagtctctcctttctagcaccgatcatttctgtggatgttgggagatctgtatgaatctgttttacatcttaccattacagctgcatttggggttaataggtatctgggactactgtcttaagtgcacaagaagtagttgcatctccagccatatctggaaaggaatctttgtgacgaacagttctacaaaccagttttttaaattaagtgtttataatattaagaaaagctcagagacttaatgtatctattttcattagttaggtactgtaatgagagacaaatatttgttccagcatgggggctaggtaagggtgaattctgtttcattgttttgttgcggctctccccatcctttggaatatttcaaaaatggaaacactcttccagctagcacctaactatcatttggttgcttaaatggtaaaaagcattcttttcagcagtcatagtggttttgaacttgctaataaataccacagcagggccccagatgtaaattcccccattcccactctctaatatgagtacctgcttcacccttgttgctgtcagaggatgtgtgaccttagctaaagtagaaagataaaagaaggaagatcacatcgacaccttctaagagttgaggccccagattcaaaatgccaaatttatggaaggatacaaatgaaccataagaaatcttatattggctgggctcagtggctcacacctgtaatcccacactttgggagcctgaggcaggaggataatgtgagcctgggaggtcgagactgcagtgagccatgatcacgccactgcactccagtctgggcaacaaagaaagactctgtcgagagagagagagaaagcaaggaaggaaaaagaaaagaaatcatatcttgaacgaagggtaactatatttgaccatctttttttattctatgctttgggataaatctcagtgtcttatgcctcagatgatatcatcagcacacagtgaaacaatattacattacattctcattatcaaactctcacaactataagattccgtcctgtttcccagaaggtcaaaatgtgttttaaaaaattaaaaactatgatatcttgtcaagaattctatcccagtcagaccaggaagcctccttatatctggcttcccttgccattcatcatacatttagcagaatctcatcattctgcaatccgtaaatcttcaaactcaaacctaataactaaaatgtataaaaatcgaatcacacatactaatgttatggaaccctctctctagtcttctgataaaaatcacagtacagtcattcattaggaacagagtcaggttgctggccagaatgcttccaaatgtattaaagttacatccattcaacttgcttattcttcctggctgtttggcatgttttctaattctagaagagtgagaataagagagagagagacagagagagtttcttagcctgtcatctcttacataggtggtgaaataattgagaatatttcatgattatttctgtaggaatctggcccttgccacatgtatatgctagaatgtatttgtgcctatgcaacaaggtgggtgttcaacaaaggctcctactttgtgtgtttttgggtttcctgggaaatgggcaagggcctagaaagttaggaatgatttttacaacttaaagcaagcccctctgtgttcaagacaatcctgtcaaaaggcattagccaaaccctagctgatgatgttgcctagcaacccactcaaagctgcaagagcccttcattgtgggaagcagggtggcaaccagaactgcctcatcccccacaaggtgattaaaagggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatccccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaacacacatggctcataaggatgtgagaagagagtgtacatttgtttgagattttaactgaaggtgttggattttgaatctgtatttctagacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacggtaaggcctttctcagaatgggtgagatggattagaggagggaggtgagagccctttcatgtttacttagcaccctagaaagacctggaggaggtgctttaaacctgagatatacaaaataagtagtcaatgaagaagcttccatttgcctcaatggaagacctcctctctgcagtgtctgccccatccaacaggaatggtatctctggcaagtgcctcaaatccatccctcccccctggtgtatacagagttgctcacaaaacttggcagcttcatcctcaatatcagttaatacatatctagtgtatctgtgcatgtggtactataataagctgccgagaggattgtttacatagttaatgtccagaagacctttcttgctgttggagttcatgacctaaggctatcagagtcattaacacatgagcttttttcagcagcattgtatgacctgaaatgcttgttattaaaggtgaggcaaaatggaacacacctttggaagcgtataaggggactttagtttgggaaatttccttcagtatcacactgaactaaagtaaaacttctggcaataataaggcagaagcagttgctttgttaaacagcagattgatagccaagcactaggcatttgtttgctgttgtaaaatgcaatttcccaataggatgtcatctgcattttgaaaagtaaaggaaaaacccttgggatgggagaaatatcttattcctctgttatgtttgagggttttatggggatctatttatttctgaggaagctgaatagtcagtagcttaagggagccttttagtcatttagctgagaaaactctgtgacccgttccttaattttgacagctaagtctgttttcactagcatatatcaagggaatagtaccatccagaactgaaaattcttggtgtttttcccactagttcccatccttgtagtaagttggagtagctgtgtgtgtgtgtgtgtgtgtgtgtgtgtgtgtgtgtgtgtgtgtgctcgctcctgaggcctatcaagttagacttttgcccaagcacttatgagctgaaaaacttcaggcttccctcataaaatgtatgctcctctccccaaccccccaccagtctcatctcttttggagagtaacatacactgtcatttatcttgagtttcccaagaaaggaaaacccctctgtgctgtttctggagggacaagttttactataaaaccaagatagcacatgcctgtaatcccagctactggagaggctgaggcaggaggatcacttgagcccatgagttcaagaccagcctgggtaacatagtgagaccttgtctcaattggaagaaaaaaagggttggggggagaataactccatttactctctagaaatttgccaaaagtttatatatgggtgtgtgtggttttttttttttcctttttttctttttgcttactgtccattattttattgtatatagtcttccatctcagctaggttaaaggagcatgattactcccaggttgcagataagtaaaccatggctaagaatgattagtgactagttcaagatcatgtaatttgttggtaggtgaattttgtttagaattcaggtgtttcttgacactcttcttacacaatattcttgattttgagaagagcttcttagtatcactgtcctaaacatagtttgttaaaattttaaaaagtattttattttgaaataaagacttaacaaattttttaaatggaacagtagagtttctacatctcttttacccagttttccccattaataataacatcttacacacccatactacattttcaaaactaagaaataggtattagtacaatataataaactaaactatagacattattctaatttcaccagtttttacattacttttgggggtgggggattggtagtggatagtactatgaactcttattacatgtatcaatttgataactgctgccagagtccagacacagacttgttctgtcaccacaaaaaaaaaaaacttcctcttgctgtccctttatggtcagactctcaccccagccctaaccccggcagcctttctccattactataattgtgtcatttttagaatgttgtataaattacacatgtaacatgtaacctcttaagattgttttttgcacacataatactcataacattcttccaagttgttacatgtatccatagcttgttcttttttatggccaagtaatagttcactgtgtccatgtaccacagtttctccattcatcctttgaagaatattttctcctttatatttaaacaaaagtttggaagtaattgtaaattcatatgtagttgtgagaaattatacagtgacctggtgtggtggctcatgcctgtaatgccaacactttggaaggctgtaatgggaggatcgcttgaggacaggagttcaagaccagcctggtcaacatagtgggaccccatctttattaaaacatattttttttaaagaaatacagtgagctcttcctgtaagtgacctgagatgatctctgctcagttggcctagaaaacccccaaaatcatacaaagcaagagattcaaatcttcatgtttactttaagaacacccgtggaagtgcccaggccatcaaaggtatgcatatccaaatagccaccaagtacttgaaagatgtcactttatagaagcaatgtgtgtcattccatattattatagtggagttggtatgtgtacctaagccaaacagacgggctgggcacaggatgacaggtggcccaaaaagagtgctaaatttgtgctgtacatgcttaaaaaggcaaagagtaatgccgaccctaagggtttagatgcagattctctggtcattgagcatgtccaggtgaacaaagccccaggatatgttgctgtatttatagagctcaggtcacattaacccatacataaactcccctgccacatattgaaatgatccttactgaaaaagagtaaattgttcctaaaccagaagagagggttgcagggaagaaaaagatatcccagaagaaattgaagaaaacaaaaatttataacctgggaataaattcagcatggaataaatgcaaataaaagttaaaaaaaatagattctgtcctcgtggtttagccacatccaccttcctttgtcccatatatttttattttatttatatatatatatatatatatatatatatttttttttttttttttttttttttttaatatagagatagggtctcactatgttgtgcaggctatctcaaactcctggccttgagcgatcctcccatctcggcctcccaaagtggtgggattgcaggcgtgagccactgcacctggcccacccgccccctgccccatatttttaaatggtgaatttgtttatacttccttgccctctttcctattcttcatcctgtctggtgactaggttctctgcccacaataccatctaaatctcccatcatagcacttgacaaataggtctaatttgttcccctaagtggcacccttttagtcattagactaaaagaagaggtggtggtagaggggtatcagaggtatctgatttgcctatctaaagaggcagactctaaagtcattctgatccattcccttcatcaccttaagttcctattatactattaatctgatctgagctaagtattaagaaagaaatcgggttgagccagcactaatgcatgacagactgatggtcccttagtctcctaagaggggttaataaaacacttctccccaaaccccagtttttattgtattttattaagaagataggtttatcctataagggtgaggctatatctctgtaagtaggtaatcctcacctgaaagataacttgtcccacgtgaagcagtgtatgttccacaccatatgccaaaagtggatgcatagccccttaattttaattaggcaggacagggtgactcttctgcccttggtgtgtctagtttggactggattcctgaatggctgatgttaaagacatgtcacataaggaattagcagttggaaagttaagccccaaggaaggcctctttctccctaggagccatacaaaatgagagccagagtcctagctatatgtaataaacttgacactttgtcagaggctggggtggaggtaggggtggggaggtgtggatattaagagtccagacacagggaaagtttcttccccatcctccaaagaccagcggtaatgcccagggcctagggtctggtcagtccatgacttcccaccaatgccagccttggcagtttgagccattgttgaggaaggcaacatttccttactagttgtaaacataaaaatgaacctccagctggaggaacttcaagtattgttacaaagatgtggaaaaatacaagatagtattttgggggagtatttggggactacctctccttagtctgggagttaactctcttaagctgttgtttctctttttagattcctcttctcttccatttctgaatccacatattctcccactagaattttccacaacactggcagtagagaaggctgtagagaaggaggtacaagaattgctttaggtccagcgcagtggctcatgcctgtaatcccagcattttgggaggccgaggtgggtggatcacctgaggtcaagagttcgagaccagcctggccaacatggcaaaaccccttctctactaaaaagacaaaaaaaaatagctgggtatggtggcacgcatctgtaatcctagctactcgcgaggctcaggcaggagaattgcttgaacctgggaggtggaggttgcagtgtactgagatcacgccactgcactccagcctgggtgacagagcaagactctgtctcaaaaaaagaattgcttcaatagggagtttgaaagtcagggaaatgcctaaagatgcaacttggaccaaaatagggagctgttttctatatataaggaatagctatattcttaagttagttgttttggttttttttacatttatcagaattgtcttcctgactaataccaagcagcagttttgggaatgccttggggactgaatattaaagctgtaaatcaatagaatatcttcccatgttcttttgtttggtttggggtttttttgcattttaaattttactttaactttttaggttgttagtttttaggaaattcaccgttgaccaaaatcttcttgaccttttattcaaagatagtctcacttttgcactatgttaaattgtccttagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcaccattaagatctttttaatattgatgtttaatttggtattcattagactaaaagaagaggtggtggtagaggggtatcagaggtatctgatttgcctgtctaaagaggcagaaaataaaagattaagctgttgatgtgaattgaggttgggttatactaagtaagtgtcttttcatgttcttgtcttccctcttaggggtgtatactctcctcattataatacagaaaggactaataccttggacctacctagtttatggttttatttcacttgattgtacatcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaagtttgtggtatgtatttttttccccagaactgacattctaggagaaaacacagcaggccagagagggacagaacattcataaccactctattaaaacttttctgactgccccagccctcccagggattcagccacatgaaattaagagtgacttgaggaagaatcatatacctcctgggggctccttttgaccaagacccaaagcaccactgcaactccaggcatctttgcaggcagggagtgctcagaggagtcaatctgtcttttcctggcagttcccctgctggggccccaggcaaatggtcccaggggcagtagccggagccacagggcctttttctgacttgtcagttggcatccagccagcagggcccagggcgagaggaatgcagcagagcttctcatcggtttattacccaggatgtctcaatcatctctcaacttacaaaagtctctcaaacccggcctcagggcctgcatattcccaagcaaatggaattaatcctgctttaaaacaagcttcccagggagttccaagactagaggcctgcatttgtgttgttgggggcatatgacccatatgttgtcaagacaggaggccccccgccaagcctaggttctgataagctgacagctgctgagatctcccactgcctggaatggggggaagaggctggaatgagggatctaacaccaagatgcccctggataagtccctgaacctctctcaccactagagtgaatgtagataaagcactctgtagcatttgagacttagtaggtgctcagcaaccgtagctgcctttattacttggatgtccaaaccccatgagcaaactgccttttggcagctaggaactttctggttgtctccatgttgccaggctgcagttagctgtaataggaaaaacacttggtgagaggggtcaaaccggggttgccagttaagaatgacgttaatttgggcaaagaaagtcctgaaggagaggttctcaactcttcggtgcacattaatgtcacctggagagctttcaaaaaagacatggttcagttcaatcagtctgggatggtacctgggggaatcagcatgttttaaaactcccaggtgttttctaacgtgcagtcaaggtcaagaatcactgccagagagagaggctcacacctgttcacctacttcctcttccacagtaatactcatgttctgtggcagttgaaaaatggttaaagcacttccatatgtacaatacctgcctattcccttacctatctcatgaatttaatttcatctccagtttacagatgagatgtggcagagccacgtcttctgactccctgtctgtgtccttagaactacactgtagcttcctccttcgtccactggaggttctgtaataggttctctcctacctctgctctcagccacatcccagcttgctaagcccctaggataccagtatgttcagagcacaccggtcccagacttgcacctgagactacactgtctttctctgcctgtaaagtgacaactaggaaacactgagatgtcaggtacattgtttctgaggtcagaaaacagctaaggactcgcaggtttgggctttctactcccacttcgtgcattaatgctttttctggttttgcttagacccagattctttttccctgccacccccagctccaggaggcaagagcctgtttattttaatacctggtatggcacttggaaaagatcacacctcccccgttgttacccaattctatctcctgaacactaatcctagaatcccaaccagcccccagacatgttattagcaacaagggatgtttcttgaaaagtttccgagttggctccaaacttaccatctcaatttctcatttagcttttgccctgccatgcttgatgctgccaacaaagggaaggctaatttgggggttggttacacccaggttctcagctggaaaagtgcttgcaatggctgtttccaagagcatcgttttgag

SEQ ID NO: 14369 - DNA, 5709 bp, Human
ttcttagaatgtattcccatcactaagcagcatatgactgtaatggggtctgacttgtagaaataaatgatttaataggtataaagaaattagaatggtgccttgcacatggcaaatgatctataatattaactattattttgttatttttattcatggctgctatggtctaaatgctcgtatgcctccaatattcatatgtgcaaatctaattttcagtgtgttggtactgaggtggtgcatttgggaggtgactgaaataagaggacctagtgctcatgaatgggattagtgccttaattagagaggcctgagggagcttgtttaactctttccaccatgtgaggacccagcaagaaagagacatccgtgaggaacggggccctcacaagactccaaatatgctggtgccttgaccttggacttccatgcttccagaactgagagaaatatattttgctgttttaagttacccagtctaaggcatctggtgatagcagcccaaatggactcagacgatagcatagttgacatttttactccagacaaaagagccaggcctggagtccctccctgtgtgtcctctgtctttctcatcagccacatgagcattgacctgtggtcctgacagtgtcctgcactctgcccacaaaatagggattcactccagaaatataaagccatgagcaagatagtccctgtccccatcacagaaacggaaggatacctgccagttctgctaccacctgcaccaatacgtgacttaacgtttttctttcaaatgattcctatttccttagatatttttatatgaaaagcaaactcattagcaccactgaaaaaagaatcagtttaacttccagacatagaaggttgccatcaaattatgcttattcatatcccctctgcatctctgttttgcttccaggactgaccttgatgcttggttttgtttaaagatttcaagcagtaaagagatgaatatatctaggccaaagggaagcttcatcattgctttgggacgctgaccggattcagacccagcagtgtcacttcgcagccctctgaccctgggctggtggcttgaactccttttattgttgttgttcagattagaatatgggttcatgaatagaagtatgtccctttagggttgctgtgagggttcaacgatgcaaagtgactaaaaagggcctaacacggattaatgttatgtagagtaataggaatatggaaggaaaaataaccctgtttcttgcattttaatttaatccggaatccgcatatcacctaaaatgatcccttttctgggagcattccacattttccaaactgtcatcctgtggtggggtgcccggctaggctatggggagacctggagagttttatgcaaaggaggacctgggcaaatgtgcccattcagcctctcaagagtggagaatgcaaggacgggggcagagccctgtgtctgttctgtccctagacataagagaaacgtggccaacagaccgaggtggggacggggacagggaccggcaatgcaggaaatccgagtgtcacatcctctgcctctcatttgcacactgctccctcgctatgctcaccgctcccgccgatccagggacgtgatccagggactctgggaaatgcaaagctacacacagtggagcgggggctgggggtgtgtagaccgccgggattccgagtttcccggcacgcctaggagagggagaggcaggcaatgtcagggaaattgggcaggcaagacgccagggacgccacgtactgccaggttctcaacgaggtggagccaaaggggcaggccccgcggtgcgcccggcgctgggctcacgggttgctgcacccggcccaggatcgcgggcggtgcagactcagcaggggcgggtgcaaggacgaggcggggcctctgcgcccggccctcttcccggactataaagagagccgccggcttctgggctccaccacgcttttcatctgtcccgctgcgtgttttcctcttgatcgggaactcctgcttctccttgcctcgaaatggaccccaactgctcctgctcgcctggtaagggacacctagctccgcgccttgggatgcccgtttcccagccacagtacagactcttcctgggtttgaagaagtcgcatttaaagttctgagctgaaggggctcctttatttcgttaggtgctttcttcccgatcacgtccctgagaccacttctcgcctccctgtgcctctaagttagagttgagggtactgaggcccaaggctgtcctgctccatgtcacccagttggtcagggggctgctggctgagccccaatgctctgaccaggctctgagcagtcagggtggatgggaagtggggggccattgccttctcggagttcaggacagaaggttctggcctcctgtcttagccttcctgggctgtgtctggagcctgggaccttgcttgtggggtaaaagcaacagaacacttgcccttcccaaaatgaagggagaggagatggggcttctcttcctctcccctgagtgggaaaggagctctgggggctggtcctgcagcacagaggaggggtcactgaagcgttattgaccagctgctgtaccttctgcatctcactccacgctcactgcctttttctcttccttgcagttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccggctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactattctggctctgggcacctcatttgtcactgggtatatggcacttggttccagttggattgtaggaaacccagattgtggggcatttcagagaggggaccatggcagtgggggtctgggtgcaaggttcctgcaatcctgcctggccttggctctcctttgtgaactatggcaaactagggggtttattctaccaccctctagcaacggttaactggtagtagctgccctttttgtgtagctgtgacacagcctatactcaccagccacctatggtgcacctactgcatacacaggcatggggtcctcagtggtgaggggaacagggagcttatggactgctggggggagagagaattatagaataaggaatcttataaaggagaaagtactgtgactgaatgcacttggggtgagcccaaatgaagaactctttccactgggatctgagagctgcattcctgcagagggcacagctccagcaaaggtctggaagtggggaagagtctggcactgggggaacagaagaccaatgtgtgattgtgtgaggggagaagcccatgttccgtttggagaggggagggcagaggccacgtgcctcattcatctgaaggatggcctcactggctgcacagctgaatcacttggagaggctggaaaagtgctcgagcctgtattccacttcccccacccctgcagccccctttccaatttgtttagggctaagtgggcccagggaacctaccttttaatttttaataagtacctaggtttgcaacccactgaagcagtcacacggaattatttggtgaaataaaatggcctctgccagttcctctctggtctcaggaccaggagatattttccatcccagttggtatttggagcaactctccagcatgtggctgcctgtcctggtggccgagggaacctggaggtgcccagcttccagctggctgtggagggagagtctggcaatcctcaacatgtagtgtggcaaatgtcttcatggagaccaaaccaagctcagagggtagatttaagcttcctcgggggctcatgctagggaaacaccacttcactgaagttgggttggtgtctgaggtgccattctctggggagagaatctgacagagacctcataaggcatgggcaggagcgtgatgtgggcactgccctgtttgtctgagatttgatccagaagccctggtgccaaagtcacaaatgcacccagccattgctggtttcataactgttttgggaaactgcagctgccaaaactctcaagggataggtacaaaatgtttttgccaggtctgacaaacatgatcattcaacttacggcttcttttccaagtcaagtgtgaagtggcatcctgttccatccctcacccccagtcctgagccccatcttctttggggctgggtgggacatgattattgtggatgtctgttggagagattaatgtacagtcattcaattttttttttgatgtggctcttattggaatgctttgtttaatttccagaggcttcagtgtcaagcacaccatcatgaaacagcctggtaaagcagttaagtgcgtcagctctggagccaggctgcctggctagacccacagctccattagtttgtcgaattatgtggtctctctgtgcctcacatttcttaactgcaatgtggggacaataataggacctacgccatagagttgtggtgaggttgaatgtggcgagcactgtccctggaacatatcaagtcctcagtaagtatgggccaggtgtggtgtctgacaatcagtaggcgatccataaatgttctctacttaattcaatgagcacttatgggaccccgttcagtatgtaaaccattgtactgcccacagagaggtaagataatatataaataagagccaattcctttgttggagatcttattcaagtctctgttgaattcagggagcaattatttaccactgcaagatgcagctgctgggctgggac

SEQ ID NO: 14370 - DNA, 107980 bp, Human
  misc_feature (1)...(107980): n = A,T,C or G
tacatacagtacttctatattcataaagagaaacattaagggaaggtgaaaatgcttctagaaggcgactggacaccagcacccttgcttactacctttgggctcttctttaaggccaacagtgacctgaaattattgactgacttttccaatcaactggagaaaatggtaccaaggtcaccaacatcagacaaattcacttgaggacctatctatgtgctttgaaagacaaaactgcttttgtaaaggatacagtatttcagaaaaacaatcatattaacaactaataatactgtaaaatgctgatgtgttgaatgctactttagaaaaacaggttcaaatctaggaaaaaaatttccgacagaaagctatgtatcaattatctagctagctatctagagacatggtctcattctattgctcaggatggagagcagtgggatgatcatagctcactgcagacttgagttgctggccccaagtgatctccctgcctcagcctcctaagtagctggggccacaggtggacacaggtacacctggctttttttgtgtgttttgtagaaacaaggtttcactacattgcccaggctggtctcaaactctggagtctcgatctgtcgcccaggctggtctcaaactctggagtctcgatctgtcgcccaggctgggatgcagtggtgcgacctcggctcactgcaacctccacctcccaggttcaagcaattctcccatctcagctttctgagtagctgggattacaggcatgtgccaccacacacagctaatttttgcgttttttgtagagaccaggtttcaccacatgggccaggatggtctcaaactcctgacctcagatgatccacccgccttggcctcccaaggtgaggcggagtcaccacactttcttatgttattaaatagcctaacccaggaagggttacagctgtaatcccaacaactctaaaggccaaggtgagaagatcacttgaacccaggacgaaactggcctgggcaacatagcgagacccccatctctacaaaaaatacaaaaattaggccaggggtgcaccgcgcccggctaatttttgtatcttttgtagggacggggtttcgtcatgttgcccaagccatccatcctcacgcctcggcctcccaaaatgctgggattacagggcccagtcagcctcatgttttctttaagcagtccctccctattgcacacttggatagttttcttttttatttttttagacagagtttacctcagtctcgcaggctggggtgatgtagtgggaacatagctcattggagccatgaaccttggagttcaagtagctgggaagctgaggtgggacttcagagatggggtcgcgccatgttgcccaggctgctcttgactgcctggcctgaagggatcctcccacctccgccgcgcctgaacatagtttcctatttttgaccaacataaacactgtgctgagttggagtttgtcagctacccttctccagcaacaacaggacctggcggggaggtcccggttaccaggctgcactccaaggagaagacagccctgctccaggcactgtaccgccactgtgacgtcgtcgaaggtccgcctctgtggcgtcgccgaaggcacccccaccttcacgcggagcccatcggaactcgaggcggggctgctgggtcttccaggagcgcccagacgcgggcaggtggccgccggtggccacaggcctgggcaggatggaagcgcccgcagagcgggcgcttccacgtctgcaggctctggctcggccgccgccacccataagctacgaggaggagctttacgactgcctggactactactacctgcgcgacttcccggcctgcggggcagggcgcagcaagggccggactcggcgcgagcaggcgctgcgcaccaactggcctgcacctggcgggcacgagcgcaaggtcgcgcagaagctcctcaatggccagcgcaagcgccgccagcgccagctgcatcccaagatgcgcactcgcctcacctgagcctgggtacgtgcgcccaacacctcccccaaccagtgccccggggaccctaggagcgtccccccacggcgcggcgctgctcgccctgggcagagtcggctgcctctgagggaaccgtattagggaaccgcacccgccagcttggcctcttatggccatagcaatagcattaaagcctgcggaacttcataggtgggtagaaggggctaggaaacgaagaaaacatctttttaaaaatataagcgatcgatgcctgggtgcagtggctcacacctgtaatcccagcactttgggaggccgaggcgggcggatcacaaggtcaggagatcgaaaccatcctggccaatatggtgaaaccccgtctctactaaaatatatatatatatatatatataaaattagccaggcactgtggtgcgcgcctgtagtcccagctacttgggaggctgaagcaggggaatggcttgaaccctggagggggaggttgcagttagccgagatcgtgccactgcactccagcctggcgacagagcgagactccgtcacacacacacacacacacacacacacacacacacacacacacacacaaatatatatatatatatatatatatatatatatatgcgatcgagcccgggaggctgaggttacagtgagccgagccgagattgcgccactgctctccagcctgggtgacagagggagaccctgtgtctaaaaaaaatagatgcaggtaggagcttttcttccggcgctcatactcagactgaagaaagtaattgggctgggcccggtggctcagatctgtaattccagcactttgggaggcccaggcagacgtatcactttagctcaggagttccagactagcctggtcaacgtggtgaaaccacgtcgctataaaaatacaaaaaataagctgggcgtggtggcgcgtgcttgtagtccccgctacttgcgtggctaaggcggcaggatcgcttgaatccaggaggtctaggctgcagtgagccatgatcgccccacttcactccagcctaggcgacagagtgagaccctgtgtcaaaaaaagaaaaacaaaaaagtaaatgacctgcgtttttgtctgtatttcctacaggataccgaaggacctgttcgaagtatttactgtaactccaactgtaacttggttctgaggaggagagaatccatgtttggtcaacagaacttttcgctgtcacttaagtttactgcttcgatatcttttccttactaattgattgttaattaagtagtgcccaagtggattagcctttttagagtttattaattaaaagagagcagcaagaatggcattttaactctcccgggttttttttcagttactatggtaactcttttcaagtccacaaatgatttgttcttatctgtaaagaaaaggtcacaaagataagcggagagagaccaaagataggaatatgtgtaagatttctacctaaatgtcggccgggcactgtagctcactcctgtaatcccagcactttgggaggccgaggtgggcagatcacctgaggtcaggagtttgagaccaacttggcaaacatggcaaaaccccatctctactaaaaatacaaaaattagccggacatgatggtgggtgcctgtatcccagctactcgggagcctgagtcaggagaattgcttgaaccttggaggccaaggttgcagtgagccgagatcatgccactgtgctacagcctgggcgacagagcaagactacatctcaaaaaaaaaaaaaaaaaaaaaaaaggatttctacctaaatgtgatagactactctgaaggttaatatttgcatattataatgtatattgcacagtgtgtcaatctcaaataatcaaaagggtcagaatctaaagggagtttattcatgcacagagttttaggagggccacctgggaaccacagataccaaagagtggaagtcagtgttccaaggcttaaaagtttgggatcacttacatagacaaagtttagagaaccttagcagaattaaagcacctctccgtttagtccaggtggtctttctttcactctgtcacccaggctggagtgcaggggcacaattgcagctcactacagcctcaacctctcaggctcaagccatcctcccaccttagcatccctagtagctgggactacaggcacacaccaacacacccaactaatttttgtattttttgtagagacagggttttgccacattgcccaggtggtctcaaactgctgggcttaagcaatccactcaccttggcctctcaaagtactaggattacaggcatgagtgactgtgcccagatgaggtggtcttttttccgggaaaggtgtgtttaaccttccacactgaagatgtaagtcatagagtcttttgtgccatctggtgtgagttaggtacagaacaataaaggaggcagttaatcttttaacaaagatgagtgattggaaggagaggaggtctagtctctggtctctcatagtcatttacagaatgaaaataataaggaaagaataaattataatttaagaaccagaagttacgaacatgctatgtggctcaatcagggtgtaacttcccccttggtgtgataaatttatatggggtcctgaaacttttttttatagttggtaggttctccacactattgatcccacaacaatttttcgaggtagatgctgctatccacattttttttttttttgagacagtgtcttgctctgtcgtccaagctggagtacagtggcatgatctcagctcactgcaacctctgcttcctgggttcaagcaattctccagactcagcctcccaactagctgggattaaaggtgcccacaaccatgcctggctaatttttgtatttttcataaagaccaggtttcaccttgttggccaggctggtctcgaacacctgacctcagatgatctacccgcctcagcctcccaaagtgctgggattacaggcatgagccactgcgcccagcccacattttagaaaagggattctaaggcacagagagttcaagtacctttccaaagatgacacagctaattagatagcagaccaggtggcctgaccccaggactttgcctttggcctctatactaccttgttgagcacagcagtaaatatttcatatgtagttttatccagaattttcctgttggttgtggtaaaccatggtttgttcttttgagacaggggcaagctctgttgcccaggcttctggtgtgcagtggcacaaacaccagcctcaacctcttgggcccagacaatccatttcagcctcccaaagcgctgggattacaggaatgagccatcatgcccggcctcacactatattttaatgctttttttgaaaatggaaacttttacaggcaattcacttccttcaaactaatgataaggaaatgatgctgttctgttttgttttgtttttacatgttttttttgtttgtttgtttcttttttgagacagggtcttgctctgttgcccaggctggagtgtggtggtgcaatcatggctcacttcagccttgacctcccaggctcaagcaatcccttccccctcagcctcccaagtagctgggactgcaagtgcatgctaccacacttggctaatttttgtattttttgtagagacaggttttcaccatgttgccgaggctggtctcaaactcctgggctcagctatcctctaccctcggcctcccaaagtgctgggattacaggcgtgagccactgtgcctggctgatgctgttcttttcaaatgcatttgttggttttttatgtgtttttttttttttttttttgagatggggtctctgtctcccaggctggagtgcagtggtgcaatctctgctcacagcaggctggtctcaaactcctgacgtcagatgttcttcccacctcaatatcccaaagtgctgagatgacaggtgtgatcaactgcacctggtgattttgcttatttagctagtagaactttttaatttaaaaaaaaatgttgttgagctggagtgcagtggtgtgatctcggctcactgcaacctctgcctactgggttcaagtgattatcctgcctcagcctctcaagtagctgggactacaggtacatgccaccacacccaggtaatttttgtatttttagcagagatggggtttcaccatgttggcaaggatagtctcgatctcttgactttgtgatctgcccgcctcggcctcccaaagtgctgggattacaggcatgagccaccacccctggccaaaaaaaattttcttttgagacagagtctcactgtcccacaggctaaagtaccgttgcacagtcacagctcactgtagcctcaacttcctggactcaagtgattctcccaccatagtctcccaagtatctgagaccacaggtacacaccaccacacctggctaattttttttgtattttgtagagcaggggttttgccatgttgcccagactggtctcaaactcctgggctcaagcgatcttccagactcagcctcccaaagtgctgggattacaggcatgagccactgcacctggcctttttaattaaatttaaattgtaaatgtggtcactgtaggaaatatgtgtattacttatctactgctatgtaacaaattactccaaacctagtggcttaaaataaatacttagggccaggcacagtggctcatgcctgtaatcccaacactttgggaggccgaggtgggcagatcacaagtccagaagttcaagaccagcctgggcgacatcatgagactccatctctacagaaaatgcaaaaattagccaaccatggtggtgcgcacctgtggtcccagctactcaggacgctgatgcaggagaatcacttgagcccggggggcagaggttgtagtgagccaagatcacaccactgcactccagcctgggtgacagagtgagagactgtctcaaaaataaataaatataaaaaaaacttagatctccatttctgtgggtcaggaattcaggagtgacatagctgggtcatttgggctcagggtgtctcatgacattgcagtcaagctgtcgactgagactgcagtcacctaaagcctgtttccaaggtggctcacttaaggtgactgctgacctgaggcctcacttcctgtcacatgagcctctctacaggctgcttaggtgtcatggtgtgacagctggctttcccaagtgagtaatcaaagagtgaacaaggaggaagccacagtaccttttatgatgtagtttgcaaagttgcaaaccatcacttttgctttttcctatctgtcagaagggaatcagttaacccagcccccactcaaggggatagggactgggctccaccttttgaagagaatatcaaagaatttgtggacatattttaaactaccatgctatgtttaattatggcaagtatggtcactgtagaaaaactggaaaatagggacaagcaaaaaaaaaaaaagtcacttataattccatgactcaatggatgacattactagttgggtatatataattccaatattcaaaatatatatttactttctcaaactataaacacactgtgtactattgtgtaatcttctctttcacacaatgtattgtatgtattgtaaaaatacctttcacgtcaaatattctttcctaacttttttttttcttgagacggagtttccttcttgtcgcccaggctggagtgcagtggtgcaatctctactcactgcaacctccgcctcccgggttcaagcaattctcctgtctcagcctcccaagtagctgggattacaagcatgagccacccacacccagataattttttgtatttttagtagagatggggtttcaccatgttggccaggctggtctcaaactcctgacctcaagtgatccacccacctcagctccccaaagtgctgggattacaggtttgatccaccgtgcccagcccctcataatattttttaatggctgcatacatttcatcatatgtatgtatcataacttatttaacgaattctattataggacacttaggttgtttacaagtttttcctgttttacacattttgttaaataaacatccctacgacacatttatttgtacaatcttcactgtttcttaaattcctagaagtaaaatttctggaatacagtttgcataattttaaaacttcaaacacctgttacctaatttgagcagaatgtttactacaatattcaagagtccattcagccaatgtcatatctatgataaaacctgcaaaagttcggatattaataactgtaagtaaatttgttgagagtgactgaaatcactatgggatgagaagttgctatagaaattttactaaagagtgaactagccaggcacagtggctcacacttgtaattctagcactttgggaggccgaggcaggtggatcacttgaggtcaggagtttgagaccagcctaaccaacatggtgaaaccccatctctactaaaaatacaaaattagtcaggtatggtggtgcacacctgtaatcccagctacttgcgaggctgaggcaggagaattgcttcaacctgtgaggcggaggttgcagcgagccaagattgcgcctgggcaacaagagcgaaactctgtctcaaaaaaacagagtgaacttcacacatctgtcccagcaaactataaatggtatatagcagaattctggtattttccattctgagttttttgttctttgttttaattaactttttcttaatttgttttttggatagaatagattaactgcttcaaaatccaaaagctactgactgccccccgcaccacagacacccagtcccactgcctgaaggcaaccagtgttatcaacttcagatattttatgcatatccaatatggtcttttctgttttacacaaataatagcacactgtactcaattctaccccttccttttttttatcacttgtagtttattttggaaatcatttcacatcaatatacagagaagattcctcattctttttttatagttgcatattatgtgaatgtgtcttttttttttttttttttttttgagatggagtcttgctgtcgcccaggctggaatgcagtggtgcaatcttggctcactgcaacctctgcctcctgggatcacgccattctcctgcctcagcctcccgagtagctgggactacaggcacgtgccacctcacccggctaatttttgtatttttactagagacagggtttcaccatgttagccaggatggtctcaatctgctgaccttgtgatctgcccacctcggcctcccaaagtgctggaattacaggcgtgagccaccacgcccagcctgccattatttttttaaccaatattctattggcaggaatttaggttttctccaatcccttaccaacacaaaataactttgtgtgaacatctaatagtctttcaatttaggaatgaatgacttagccacgtttgagtaaaatggtgcctgttctggtctggattcctttctgtcttgaactgtccaaagttctcctcactctaaacccttcttgtgccagaatgtatcctttataagactgcttttcttcatctctgcttttgaattatctaaaagcaagtaaaaagtcttattatttgtaaagcattcattcttttaagaagttatgtaaaaataaagctttgttttttacaaaagatttttatataattcaccctttttattgtttgaaatctttttatttcaatacttttgggggaacaggtggtgtttggttacatggaaaagttctttagtggtgatttctgaggttttgatgcacccatcacccgagcaatgtacaccgtactcaacagtgtagtcttttatcccttacccacctagcacatccctccaaatccccagagcccattatatcattcttttgcctttgcatcctcatagcttagctgccacattattcaccctttagttccaagtacattctgctgttgctgggacacaggaaggctgttttaaactctacttcctctgatggaagggagaaatttctgattgacatcaagcagaaatggttccatgtgtgcttcctctcctcaataaacctcactccaaccgcaagggactttcccatgagccccttatgaaatgccactagccaaatttccccttattttagcgatgtttaatgtaactgttgaaagcatttcaggctgggcctggtggcttatgcctgtaatcccagcccttgcaggccgaggtagatggatcacctgaggtcaagagctcaagaccagcctgaccaacatggcgaaaccctgtttctactaaaataaaaaattagccaggcgggttgacgtgcgcctgtaatcccaactactcggaaggctgaggcaggagaatcgcttgaatccgggaggcggaggctgcagtgagctgagaacgcgccactgcactccagcctgggcgacagagccagactccgtctcaaaaaaaaaaaaaaagcatttcacaccaagtatcactaaagcacagatccttggggcctttgcaattgctgttctctcttcctgtagtgttcttatcttcataaacacatggcttgcttccccacctcttcaagggctccgttcaaatgactcccccccgccccgcctaacctctaatttccagtctccttcctctcttttcatgtcaccaccacctgatttacgtaggcgtttgtgtctcccctccttgaaacttaacttcgtgaaggtagaatcttatctgatttggtgcagtatctccataacccagttagacagtaaatttttgttgaatttaccagtgtatggttactgtcccaattctggacacaaattctataatacatatgaaaaggagctgaaaatatatagtaatacataaatgtaaaacattattgctgcctgaatttaacttttgctgactggatccacagacaagaaagagaaataccaaatacaactaattcaactctgtttatttttgacgaaaccgatttctttcattcagttcatactacgcgtccacactgtgcctccaaaaatatttgcccttataactgaatgctcagaaaggctaagaaatctgcccaaggtcccctggcaatccagccagagatgtgagtcactcttaaggttggatttaatacaaatgtttgaaggacggagcgacaggccagctgccctagggaagcaaaatgctaagtgctctgatgcgaggaccggaggacaaggttcgcggatgaaccacaggaacttccgggttttaaagatcctggcgccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaaggtcggctgcggcgtgggctcgcctctgccaggcgggggtagattgaacgtaaagcctatgttaggggagtgtggggagggaattcacttacggaaaaagcttcctatccaaacaacgggaaaggcataacgttatggccaggtggtaggaaggcataaattttgacctagcttgatttcggggaaaagagcacccaaggaaataatccggaaatggtcagagggagcgtgatacatatgaagatttttaaatacgtgcaggacataattagtcttttgttatttgagaaggggtctcgaaattgttgaaagcatctgaacgttgaacagatgaggaatagttgaagttgcttttggtataatagttcagacgagtcactttggccagtcttgttttgtaatgtgtaaaatgaaggaattggactagattatttccccagttgaccatctttaagtcctaattagaatgtttatttatttatattttgagtcagagtctaactcaggctgtagtgcagtgacgtaattatggctaactgcagccttgacttcctgggctcaagctattctaccacgtcagcctccagagtaactgggactacaggcatgcgccacctgtgcaccacacttggcgactttattctattttatattttagcagagacagggtctcattatgtggccctggctggtctcaaagtcctggcctcaaatgatcctttcgcctccacttccctaatcactgggattacaggcaagagccaccactccgcagcctatgttaattatttgatccgtcaataaaatgtaaactccatgaatgcagagatttttgtctcttgttcacagttacattaccagcgccttgtagttacctaatacttgaatgaatgaatcctgtaagaatctttctaacttttagtagtctgtatttcttatgacatgttggatatgtctttaaagatactgtgggctatccgaatacatggaaattgttgcaaagaagcagaaaaaactagtatgtcctaggctattactattataagaaaagattaaagtggccgggcgtggtggctcatgcctgtaatcccaacactttgggaggtcgaggcgggtggatcacttgaggtcaggagttcgagacgagcctggccaacatggtgaaactccgtctctactagaaatacaaaaattagctaggtgtggtggtgcgcgcctgtaatcccagctacttgggaagcggaggcagaagaatcggttgaacccaggaggcagaggttgcagtgagattggatcgtgacactgcactccagtctgggcatcagagtgaggccctgtctcaaaaaaaaaaaaaaaattaggccgtgcgtggtggttcacacctgtaatcccagcactttgggagtccgaggcgggtggatcacctgaggtcaggagctggagaccagccatggtcaccatagtgaaacctcgtctcaactaaaaatacaaaaaattagccggaggtggtcgcgggtgcctgtaatcccagctactcggaaggctgaggcaagagaatcgcttgagtctgggaggtggaggttgcagtgagctgagattgcgccattgcactccagcctgggcaacaagagcgaagctccatctcaaaaaaaaaaaaattgaagagagaaaatgatgtaaataatttgaaatgaaaatcttgaggtccattttaatatgtaagttattttaagttgacaatttccaaaactggttggaattgggaacttgatgtttttttcttttctttcacagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggtgggaatttaggcagcatttcccttccatgggtggattttatgagaaaagccagacgtttgtaagttccttaagtgtaggaattgtctttgattttagaacccactgtgctgttaatagacaatgggttttaaagccacatttggccgttgagttactgccttaggccagcaccaacaagtactgtacaaattgtgtttcttcccaaggaggagacttacaacagtccacttgactcactgtaaaacaaccacttttccctttgaatatttcatcccagtgacacttcctactaatcttgtcttgatcttagttaacaaatcaaaaatctcgcatagctgtgtgttcttttacgtgatgtttgccattacccatctttctgatgtgtgtgggctttctagtctaatgagcataggtgtgtatactcttgtatttccggtgtgcttgaaactgctccatccagttttctataatagtaccatttttcctccctgaagcttcagtaaaccatttagtcttgataacaagataataattccactttatttgcatctttatttaggaatctttctggttgtaattggaattttgttaaaactgttggctttcagcttttaaatattttcacttttggctgggaacggaggctcatgcctataatcccagcacattgggaggctgaagtgaagggattgcttgaacccagaagtttgagaccaggctgggcaacatagcgcaaccctgtctttactaaaaatatttatttaaattcttcttttttggaggtggagtctcgctctgttatccaggctccaccgcccgggttcaagcgattctcctgcctcagcctcccgagtagctgggattacaggtgcctgctaccacgcctggctaatttttgtatttttagtagggacggggtttcaccatattggccaggctggtctcaaacgcctgacctcaagtgattcacccttctcggcttcccaaagtgttggaattacaggcgtgagccaccatgtttggcctaaaatattttttaagtaaatgaagatttaaatgttttcacttcccatgttaatagttggaaactttaattagcatctggtgctagttccattttccattaacctcaaagaggatggatactcttcattgtctaggcataagtatgattttctttctcagcaatgttgaatgttttgcctttgcaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggtaggtaatttgtccaatttacatctgcttaattcacagtggaattcctggatcctgtagaacttagggtaatctgtgtttaataaattagagaagactttgttgaaatttctctagaattaactcctaacaactgggccggaggtttctagtcatttttatgagtaattttctgaattttcttcctttagaaggtataggccaggcacagtggctcacgcttgtaatcccagcactttgggaggccaagacgggtggatcacctgatgtcaggagtttgaggccagcctggccaacatggcaaaaccccatctgtactaaaaatacaaaaaattagctgggtgtggtggcaggcacctgtaatcccagctactcaggaggctgaggcaggagaattgcttgaacccgggaggcggaggttgcagtgagccaagatcctgccactgcattccagcctgggcaactgggtgtctccagtgggagacactgtctcaaatttaaaagaaaaaaaaaaaaaagaaggtataaatcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaaaccattcttaatatatgcagttcccctgaaggtgcttttgctctgtttaaggtgttgtagcctcctcttcctaaaacactcaggctaactgccatcccccactccgtgctagggaagaactttaaggggatggaattcaatttggagtaggccacttttttcatgtcagatgggtagtgtgtcaatgcaaccagttttgagggaggcacacttcatgagtgtgaaaaccctgtcatcacacttaactacaaaaggatcagcaggtcttttttttttttttttgaagtgagcagcagagatggtttcactatgttgatcaggctggtatagaactcctgacctcaggtgatcccccagcctcggcatcccaaagtgctgggattgtaggcatgagccaccacacctggcctccgtaggttctgttttctgattttttttctgagtttcagagccctgcatcactgccaggtgagtgaaatgctggtgattgagggaattagccagttgctgtctcgcctcctatcagctgtgttcctggagtgcctaaacattcagttcctgaaagaggctccctttcagaaagagggtctcagcacagttcactcctggccagttccccggcatattccctcctgggtttatagaagacacttttgctaattttcctggaggctcgggacctctgtgagtctgtagtgttaatgctcagatgtccctcgtgtccaggtgtagtggtgattcaaataaattgaatcaaagaaaaatgacgaaatgtaagcgtgactggccaggcctactccctggtaggagtcattgctacaaggagaaaggtgtggaataatcctctaggtgcactggccttttgccctaaagtcagaaaggattttgtgatgcattcattgattgtccagttggcgctccaattccctgagtttggtgtccatggattcagccaatcgaggattgagaatatttgaagtctgtgcaataaagtgagatccctacaaaaaataaatcagccaggtgcagtagcatgcacctgtagtcccagccactagggaggccgaggtgggatcacagaagcccagttcaaggttgcagtgatctatgatcacaccactgaactccagcccagagtgagaccctgtctcaaaataattttttggaaaaattcatggtcatttttgtaggaaacatgtagactattttccttgtcattccctaaacaatacagtgtaacaactttacatcctgtttatgttatactaggtattataagtaatctagagatgatttaaagtatacagcaggaaatgcataggttatatgcaaataatgtggcattttatgtaagggatgtgagcatccgtggatttttgttatccataggagccttggaaccaatcttggaagataccttagaaaccagcaagagtcaaatctgtagcttagaaatgtgagggagaaaataggtttttaatggtaaattaggcagggcgcagtggctcatgcctgtaatcccagcacgttgggaggctgaggagggcggatcacctgagttcaggagtttgagaccagcctagctaacatggtgaaatctcatctctactaaaaacacaaaaattagcaaggcatggtggtgggtgcctgtaatcccagctacttgggaggctgaggcaggggaattgattgaacctgggaagcagaggttgcagtgagatgagattgtgccactgcactccagcctgggcaacagagcaggactgtctcaaaaaaaaaaaaaaaaaaaaattagccaggcctggtggcacacacttgtagtctcagctactcaggctgaggcaaggagaattgcttgaaccctggatgcagtgagccaggatcgtgctactacactccagcctgggtgacagagtgagactcttctctcaaaaaaaaaaaaaaaaaaaaaaagcaaattagacctggcacagtggctcatgcctgtgatcccagcactttgggaggccgaggtgggtagataacctgaggtcaggagttcaagaccagcctggctaacatggtgaaaccccatctctactaaaaataaaaataaattagccaggtgtggtgacgtacgcctgtaatcctagctactcaggaggctgaggcaggagaatcgcttgaacccgggaggcagaggttacagtgggccaagattgtgccattgcactccagcctgggctacaagagtgaaactctgtctcaaaaaaaaagaaaaaacaattgctggccatggtgttgcccgcttttggtctcagctattcaggagcctgaggtgagaggatctcttgagtccaagaggtcaaggctgtagtgagccatgtttgcgccactgcactgcagcctgggcaacagagcaagaccctgtataaaaagcaaaaaaaaaaaaaaaagagaaaacagtaagttaaagagttccaggtatttaaaaccttgcagaatttgtgtttcaatgtgttgcatttcagtaagttggaggcttttatgcttagcactcattccctgaagtatttttcagctcttttgtatgtaaacaattcaacaaaaattttccccaaagtgaaagaaatagatggtcagcattattattattatttttttatttttgggacagagtctagcattattattattattattattattgagaccgagtctagctctgtcaccaggctggagttcagtggtgtgatctcggctcactgcagtgcctcccgggttcaaacaattcacctgcctcagcctcctgagtagttgggattacaggcatgtgccactgtgcccagttaatttttgtatttttagtagggacggtttcaccatgttggacaggatggtctcaatctcctgacctcatgatccgcccacctcagcctcccaaaatgctgggattacagatgtgagccaccgcacccagccagatggtcagcattataaggaactgctggcgcccacaacatctggggttaatctaggctctctgactcacctacttggcaaccttgaccaagtcacaatctctctaaaattggcttaataccagggtttcgttgtccaagtgaaactgtatgaagtgctttgtaaaatgtgtatcaattaggtatctgtggtcaagtgtggtttctcacacctgtaatcccagcactttgggaggaccaaaacaggaggattgcttaagcccagaattttgagaccagtctaggcaacatcgtgagacccctatctcttgttattttattttttattttttttgaggcagagtctcgctctgtcacccaggctggagtgcagtggcacgatctcggctcactgcaacctctgcctcccgggttcaagcaattctcctgcttcaacgtccagagtacctgggactacaggcacccaccaccacgccggactaatttttgttttgtttgtttgtttgtttgtttcttgagacggagtctcactgtattgcccaggctggagtgcagtggcgcaatctcggctcactgcaagcttcacctcctgggttcacgccattctcctgactcagcctcctgagtagctgggactacaggcatctgccaccatgcccggctactttttgtattttcagtagagacggggtttcaccatgttagccaggattgtctcgatatcctgacctcgtgatccacctgcctcggcctcccaaagtgctgggattacaggcgtgagccaccacgcccagcctaatttttgtatttttagtagagatgtggtttcaccatgttggccagactggcctcgaactcctgacctcaggtgatccgcccacctcagcctcccgaagtgctgggattgcagatgtgagccaccgcacgcagctcccatctctattttaaaaattaaaaatacatacaaaattaaaaacagccaggtgccatggcacgcgcctgtagtgccaactactcgggaggctgaggcaggggaatcacttgaacttgggaggcggaggttgcagtgagacaagatctcaccactgcactccaccctggcaacagagggagactccacctcaaaaaaaaaaaaaagaaaaaaattaaaaacatatttgtgggctcagatcatgggtaaagcactgtctcccctacgttcaccccctgccatcaatttggaatattaggagtttggaaaaaggtagttttagaatgagagggaacaatgaaaactaagtgtccactgtgtgcctgcatgctgcacagtgctgccagttttgtcaactccctgtaaggtagactcatactgatgaggaccctggcaggaagtcacatgcaccgagagaccacgtttttcctggcatatgaaactcctcacaatagaaactgcaggctgaaaatgaaatgggtaaggaaagttctttaaaaaaataaaaatagggctgggggtggtggctcacacctgtaatccgagcactttgggaggccaaggcaggcggatcatgaggtcaggggttcaagaccagcctgaccaacatggtgaaacctcgtctctactaaaaacaaaaatcagctgggcgtggtggcacgtgcctatagtcccagctactcaggtggctgaggcaggagaatcgcttgaacccgggaggcagaggttgcagtgagccgagattgcgctactgcactccagcctgagtgacagagtgagactctgtttcaataaatacataaataaaataataaaagtaaaaggctgggcatggtggctcacgcctgtaatcccagcactttgggaggctgaggcgagcagatcacctgaggtcaggagttcgagaccagcctgttcaatatggtgaaaccctgtctctactacaaatacaaaaattagccgggcatggtggcaggcatctataatcccaggtactcaagaggctgaggcaggagaatcgcttgaacccgggaggcagaggttgcagtgagccaagatcgcaccgttgcactccagcctaggtgacaagagtgagactccatctcaaaaaaaaaaaaaagaaagaaatacaaaaattagccgggcatggtggcttgcgcctgtaatcccagctactcgggaggctgaggcaggagaatcgcttgaacccgggaggcagaggttgcagtgagccaagatcgcactgttgcactccagcctgggcgacaagagtgagactccatctcaaaaaaaaaaaaaaaaaaaagaaatacaaaaattagccgggcatggtggcttgcgcctgtaatcccagctactcgggacgctgaggcaggagaatcacttgaaccccagaggcggaggttgcagtgagccaagatggcaccactgcagtccagcctgggcaacagagcaagactccatctcaaaaaaataaaataggccaggtgtggtggctcacgcctgtaatcccagcactttgggaggctgaggcaggcggatcacgaagtcaggaattcaagaccagcctggccaaaatggtgaaaccccgtctctactaaaaatacaaaaattagcctggcgtggtggtgcgtgcctgtaatcccagctactcaggaggctaaagcaggagaatcatttgaacctgggaggcggaggttgcagtgaaccgagaccgtgccactgcactccagcctgggtgacagagcaagactctgtctcataaaaataaataaataaaataaataaataaataaaataaaataataaaaataaaaggccaggcatggtggctcacgcctgtaatcccaacactttgggaggccaaggcgagtggatcatctgaggtcaggagtttgagaccagcctggtcagcatggtgaaatcctgtctttactagaaatacaaaaattagccaggtgtggtggcaagcatctgtaatcccaggtactcaggaggctgaggcaggagaatcgcttgaacctgggaggcggaggttgcagtgagccgagactgtgccattgcactccagcctgggcaacaagagtgagactccatcccccaaaaaaaagggccaggcacggtggctcacgcctgtaatcccagcactttgggaggtcgaggcaggcggatcacctgaggtcaggagttcgagaccagcctgaccaacatggagaaaccccgtctctactaaaaatacaaaattagccaggtgtggtggcacatgcctgtaatcccagctacttgggaggctgaggcaggggaattgcttgaacccgggaggcggatgttgcagtgagccaagatcacgccattgcactccagcctgggcaacaagagcaaaactctgtttcaaaaaaagaaagaaagaaagaaagaaatacaaaaaatagccgggcatggtggcttgcgcctataatcccagctactcgggaggctgaggcaggagaatcgcttgaaccccagaggcagaggttgcagtgtgccaagatcacaccactgcactccagcctgggcaacagagcaagactccatctcaaaaaaataaaataggccgggtggtggtggctcacgcctgtagtctcagcaatttgggaggccaaggcgggcagatcacctgaggtcaggaattcgagaccagcctggccaacatggcgaacgaaaccccatctgtactaaaaatacaaaaattgctcggtgtggtggcgggcacctgtaatcccagctacttgggaggctgaggcaggagaaccgcttgaacatgggaggcagaggttgcagtgagccgagatcatgccactgccctccagcccaggcaacagagcaagactccgtctcaataaaataaaataaataaaacacataaataattttaaaaacccacacatctgatgtaagattaaaggaaggtttttttgttttgagacagggtctccctttgtcacccctggctggagtgcagtggcatgacttcggctcactgcaacttccgctttccaggtttaagtgattctcctgtctcagcctcctgagtagctgggattacaggtgtgcactaccacggctggctaatttttgtattcttggtagagatagggtttcatcatgttgtccaggctagtctcgaactcctgacttcaggtgatccacccgccttggcctcccaaagtgctgggattacaggcatgagccaccgtgcctggccttaaaggaaggctttttagatgaaattatggagggtagatcagaggtggattcctgcaggggaaggtcccttattgattgattgattgattcagactgagtctctgttgctcaggctggagtgcagtggcatgatcatagctcactgaagccttgacctcccaggctcaagtgatcctccccactaagcctcttgagtagctgggaccacaggtgtgtgccactacacctggctaattttttaatttttttgtagagccagggtctcactttgttgcccaggctgctgtcaaactcttggacttaaacaatcctcccgcctcggtctcccaaagcgctgggtgtgagccactgcacccggcctccctaacctgtacaggtctgcattatgtagggtgatcatgcacactgtccctgcgacagcccgggcagtcagctgctgcagtcatgcattgagaaagcctccagggcagtgctctcagcatacgtggaaatcaaaattgctcccagagaagcaagtgccctccgcacaaggctggatttacgttctctgggcctggaggccaagggagctccagaggggagactgatcactcttacatcctgtctggcctggtctcaggccacacaagcttccctcaccctccaccagaggtcccccaccttccgcccggagactgggctccatgccctgtccctgcggagccttggcctgcctcccgggtttgcagttgtgatttatttttggcacgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccgtgagtagctagcccagtgatggacaaaagccaggtgataggcagggagcggggaggactgggggtggagaagatagaaacccccacatccattccatccatgtctcttttctgaaggcggatggaccagggagagtggcagcattgacccttgaaacctccatctgcaggaattttctacagaaaagaggtccccgggactgatctggtttttggactcagagttcaggggagggaagttatgtgccaaaaagtaccaggccaggcaggcgcgatggctcacgcctataatcccagcactttgggaggccaaggtgggagggtcacttgaggtcaggagttcaagaccagcctggccaacatggtgaaaccccatatctactaaaaatacaaaaattagctgggtatgatggctcgtgcctgtagtcctagctactcaggaggctgaggcaagagaatcgcttgaacccggaaagcagaagttgcagtgagctgagatctcaccactgcactccagcctgggcgacagagcgagattctgtctaaaaaaaggactgggccacctactcccatgtggtgaccctgtccacaggggtcttgggaaaggtgtgaggggtgggtggggcagtagacagaggcacaaagttggccccagtcagagctggggctggggcaagataaccgcctcctcagccccccaggaaaggtgagtgcagccacaagttggccaagctggctgtgccaaggactggaggcttgcgcctaggctggcatctcatatgggggtccaagtgtactttctgctcatggagggctgggggagaggagagagctagcgctacccagctttgggaggtgatgaggcaaaggtgcccattgtgaggacttaggacttaccagcaaatgggcttgtttttatgggaaacagacagtcccgggctccgccaagttgctgatggggcaggcagagaaggcctgtgtgtgagcagcccaggggcctggcaccagcagaggggacttgttattctaaaccttcttctggtaaccaggcacccagtagtggggccaccaggattcctggaacagcctgcccaatcccggaggcagccagagctgctgttggctggtcagcaaattggctcctttgtgagaccaggccttcttaggcccagaagcagtgggggaaagggggttggaggcagctttggcactgctgagtggcaggttgggcctattttctatctgcccttttccctgttggttttctgcattcctcaaatcctgcatctgattttgttttgttttgtctttttttttttgagatggagtctcactctgttgcccaggctggagtgcagtggcatgatctcagctcactgcaagctccacctcccgggttcacaccattctcctgcctcagcctcctgagtagctgggactacaggtgcctgccaccacgcccggctaattttttgtattttttagtagaaacagggtttcaccgtgttagccaggatggtctcgatctcctgacctcgtgatcctcctgcctcggcctcccaaagtgctgggattacaggcatgagccactgcgcccagcctgttttgtcttattttttgagacagagtctcactcactccgtcacctaggctggagtgcactggtgcactctcagctcactgcaaccccacctcctgggttcaagtgatcctcctgcctcagccttccaagtagctgggaccacaggcccgagagccatcatgcctggctaatttttgtattttttgcagagatggggtctcgccatgtagcccaggctggtctcgaactcctgacctcaagtgatctgcccacctcagcctcccaaagtgctgggatgacaggtgtgagccatcacgccacgcctaaatcctacatctgaagcaggagttgagttccctggtaggagcctccatgttcctgacacaaagcggggtagctcagcgcctctgtgtacaggcctgagtgtcctggctctctactgcctctatcctgcagcaggacccctcagggctcactggccattgttaagtaggacatggggcattcttccagcaggaccctgagccaaaggggtacctgcccaacccttgactcacattcaaggtatagcccctgccggacacctgcactgggtatggggggcagagatggctaggacatcctagagatgataatctagtgggggaggtgacagcatacactgacaagtgacaccagaggcagggaccaggatggacccacccagctctccatccctcagagcacccagcatggtggttggcaaagagtgggtgttcagtgtctgcagaatggagatgtaatgaatgagtgagtgagtgattatgaaagtcccagttatggatagaatacatgaggaagggccaggtgcagtggctcatgcctgtaatcccagcactttgggaggccaaggtgtgtggatcatttgcggtcaggagtttgagaccatcccggccaacatggtgaaactccatctctactaaaaatacaaaaattagccaggcatggtggtgcatgtctgtaatcccagctattctggaggctgaggcaggagaattgcttgaaccttggaggtggaggttgcagtgaaccaagaccacaccactgcacttcagcctgggtgacggactgagactccgtctccacaaaaaacaccaaaaacaaaaacaaacaaacaaaaaaacatgaggaaggagcagtgggatggagtgcaggaagcctgtcctagaagggggtgtgttttcagagaacacagtcacaacaaggggagataaggagaggctacaggagtggcctatttaaaaggaaattgtggccaggtccagtggtggttcatgcctataatcccatctctttgggaggctgaggcgggaagattgcttgaggccaggagtttgagactagcttgggcaacatagggagaccccgtctctacaaaaaacttaaatattagggcctggcatggtgtttcacgcctttaatcccagcactttgggagaccaaggtgggaggatcacctgaggtcaggagttcgagaccagcctggccaacatggcgaaaccctgtctctaataaaaatacaacaattagccaggcgtggtggtaggtgcttgtaattccagcttcttgggaggctgaggcaggagaatcgcttgaacctgggaggtggagggtgcagtgagctgagagccaagattgtgccactgcactccagcctgggggatactttagtcctagctactcaggaggctagggtgtgaggatcgcttgagcccaggtggttgagccggcagtgagctataatcgtaccactgcactctggtacagagatgggtaacagagcatgaccccatctctacaaagatttttttttttttgagccggagtctggctgtgtcgcccaggctggcagggccaaccggctagtatccccccgtccaggacaccctctgccccctgggttcaagcgattcctccctggccccaacaccgggggcgccccgggaccccaagtgggtgccaacaaaggcgggccaaacgtccggtagggcaaaccgagcccgtttcacgcggctcgcccaggggtccccagggccccacactcgagtcccnnnnnnnnnnnnnnnnnnnnatgaccccatctctacaaagatttttttttttttgagccggagtctggctgtgtcgcccaggctggagggcagtgatgcgatctcggctcactgcaacctctgcctcctgggttcaagcgattctcctgcctcagcctcccaagtagctgagactacaagcgtgtgccaccacacccggctaatttttgtatagtagagatgaggtttcaccatgttggccaggctggtctcgaaatcctggcctcaagtgatctatctgcctcagcctcccaaagtctgggattataggtgtgagccaccacgaacggcctcaattcacaaacatttatttggaacattcactataggccagtgtagtgccaggagatgtaaggatgagtgagaaacagttccagaccccaaggagaacagcccctgggtcaggaaggctgacagcttctttcttttcccctctcagagccacccagagttccctcactgaagatctgagcatgacccgggacgaggcactgccggactctcattctgcacaggacttctatgagaattatgagcccaaagagatcctgggcaggtaaagcccaagctttccccacgaagtgctgtcctaggctccagcagaccctgtgggctacagccagctctgctccaccccgagtactaacgccactttcatccccaaagtgctgttcacttggagaaaccctttgtttggggtcctgccctcctgaagccaggacagataagagaaacctctcccagcaaaaagttcccaggggcaggcgcaatggctcacacctgtaatcccagcactttgggaggctgaggtgggaggattgcttgaggccaagagttcaagatcagcctgggcaacatagcaagaccccgtatctttttttttttttttttaagatagggtcttgccctgtcatccaggttggagtacagtggcatgatcttgactcactacgatctctgcctcctaggctcaagtgatcctcccacctcagcctccctagtagctgggacaacaggtatgtgccaccaggtctggctaaccatctctatttttttttttaaaagggggggccaggcacagtggctcatgcctgcaatagcagcacttcctgcaataccagggaggccaaggcaggaggatcacctgagatcaggagtttgagaccagcctggccaacatgttgaaaccccatctccagtaaaaatacaaaaattagctgctgtgtggtggcaggtacctgtagtcccagctactcaggaggctgaggcaagagaattgcttgaacccgggaggtggaggttgcagtgagctaagattgtgccactgcactccagcctggcaatagagcgagactccgtctcaaaaaaaaaaaaaaaaaaagcactgaacggctcaaaaaggaaaaaaaaaaaaaaaaaagagtcacacggcctgagagcaggcttgttactcaccagttctgggcaaatcacctgtctgtgcctgtatttattcatccaccatttccaaaagctcagaggaagttgggggaaagtgtaaatctctgtcaagggcaggacatctctgctgcagcctctaatctgggaccccccatggggtgaggggccccccgaggccatctgtcctctgcactcccaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagtgagtgatggccccaagccacacggcagggtgcccccctgtgattctgccctgacagcccaagccagggagtgtggccccaccgcacagccaactagaaccacccaggctcaaggctcccagctccaccctcactgctctgatagaaggggtcccaggcagggatggatgcaggcaggggaatgggggtttgatgtccctgggctgaattagccaggcatgctggtgcatgcctgtaatcccagccactcgggaggctgaagcaggagcatcactcaagcccagtagtttgaggctgcagtgagttatgattgcactattacactccagcctgggtgagacagtgagatcctgtctctaataataataataataataataataataataataataaagtccctgggcctgcccacatcccaggttgacgtctttgagcaccctcctgattcccctgtcagcttttgaagttagcccacagcagcctcggtccctgacccccgtgccccggctgccccctgcctgggctccccctgctacttgagacaagctagccatttccatttcagtacagctgaaggacacttatgagaccaacactttcttcttcttggtgtttgacctgtaagtacccagcactggagcaagccacacctgagagaacctccgactgctgtcccctccccaaccccagggctgcctggagaccacagccagctcctgcgctgaggatgccaaatacaatcacggtgtttagacagatcagcccctggggtcaggctgccggctttggaaacctgggttcaccacttgtgggctggatcatttctttaaatcttggttttctcatcagtattatgggagtgataatagcacagtgactggcatagtgtgaatactaataattattagctacaggcgggcgcagtggctcacaaccgtaatcccagcagtttgggaggctgaggccccagctacgcgggaggctgaggcaggagaatcgcttgaacccaggaggcggaggttgaagtgagccgagatcacgccgttgaactccagcctgggctacgagagcgaaactccatctcaaaaacaaaaacaaaacaaaacaaaaaaaaccccaaaactcttggcctcacgtgattctcccaccttggcctcccaaagtgctgggattacaggcataagccaccgtgcctggcacagtatagtgatataattgttctattttattattggttgttagtctctgactgtgcctaacttataaacttcatcttaggtatgtacatataggaaaaacatagtaagtataggcttcagtgctatccatggtttcaggcatccactgggggtcttggaacatatcctatgcagataaagagggatgactgtagacatatataaagtagaacaaggggttagcaagagacaggggcttccttagaccgagtggtcaggaaagcatgtccaggaagtgacccaagcagagggtggcaggatgtaaggtcggtcagcaccaaagaccaggtcctgcaggcattttagccatagtaaggagtttggagggtcaagactgggagggtgacatgatctgatttacttttttttttttttttgagacagagttttgctattgtcgcccaggctggagtatagtggtgcgatctcggctcactgcaacctccgtctcctgggttcaagtgattctcctgcctcagtctcccaagtagctgggattacaggcacccaccaccatgcccagcaaattttttatgtgtgtactgttttagtagagacagggttttgccatgttggccagtctggtctcgaactcctgacctcaagtgatccactcgcctcggcctcccaaagtgctgggattacaggcgtgagccactgcgcccaggctgacttccttttgaaaagatctcactgactatctagggacgactgtaatgaggcgggattggaaaaagggaggccagcagtattgaggagagaggcaggtggtagaggttgcatctggggtgtggtccaaagatcaatatcatcatcaccatcaccaccatcatcaccatcatcatgcccctgctttggcatcaataggattagtaagatgagccccttatttctaagcatcaaatgtgaacaatacaaagtgctctgtgaaatgcaaattccagacttatcatgggccaggcacagtgctcacacctgtaatctcaacactttgggaggctgtggtgggaggattgcttgaggccaggagtttgagaccagcctgggcaacaaagtgagaccccatctctacaaaaaaatataaaattaaggccaggcatggtggttcacccctgtaatcccagtactttgggaggctgaggcaggcggatcagatgaagccgggagttcgagaccagcctgggcaacatggcaaaaccccatctctacaaaaaatacaaaagttagcccaggatggtgacagatatctgtaatcccagtcactcaggaggatgaggcacaagaatggcatgaacccaggaagcagaggttgcagttagctgagatcgtgccactgcactccagcctgggcaacagaggaagactttctcggacccctccagactcaccagctgcagctgtctcgactgctctgtggcactgtcctgtatagcccttggggacagctcaaatgtctttaacctttgaagaagttgctgggggaagctatttttaatgctgccctgaggagccctccagggtataactagattgttctagcagagtcctttctagatcatcccaggaggtaagaagattgaacctcaattcttaatcctgtaattggcaaactttgctcctgcaactcttgcacagccgattcttcccatttgtttcctgggaaaaaatcgggatactcggccaggcgtggtggctcacgcctgtaatcccaacactttgggaggctgagacgggtgatcacctgaggtcaggagttgaagaccagcctgggcaacatgatgaaacgctgtctctactaaaaatacaaaaattagctgggtgtggtagtgggcacctgtaatcccagctactcgggaggctgaggtaggagaattgcttgaacctgggaggcagaggttgcagtgagccgagattgcatcattgcactccagcctgggtgatgagcaaaaactccatctcaaaaaaaaaaaaaaaaaaaaatcgggatactcacgtccttctgatctgggtctggggtcctgggccagtggttcatagtcccctctttcagcctccagccatcatttaggccccgatacatcccagtccacactgtcacttccacagatgggaagacactgatacaatggagatggaacagaaatggtgcttgggctgggactctcccaagtccaccaacttcagggcccagggcagggcaaggtactgctcacagggccaccagctcggggcccattgcttccctggtcacttctagccatcctggcctggaactagggtaatgggaacctggggaggggacttagctgaagaaatgcctacctcatgaaatggtgggaaaaatttttccaggggaaaaattcagtcaggggagaaacctaggcctattcctcggagggttgatgagagcctgagcccctgatgtgggccacctctccagcctcctctgcttttctcccagttcttccagaacacttctcacttccccggctcctctccccagactgtggttctccacggagagtggcccacttagcttctagaggtatcagggtggaaggcagctctctgggagcagggtaagggcagtggtggtcttgggaccgatccagctatcaaccctctgtttccacaggatgaagagaggggagctctttgactacctcactgagaaggtcaccttgagtgagaaggaaaccaggtgagggtccctttgcccttctctccgctccctcccacgtggcttagggccacaggcactggggtctcaggggaggcagggcgtgcacatgtctgggctgggcgtgtgtgctgctcccttgcagtgtggctgaaatgtgagctgtgtctccctgcctgttacctgaccctgagcagaggaagagtaacaagtgtgtgccccaccctagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctggtaacatggccttggcccacgtccaggcctcgggtgctcaatcaaccatctgcagaatagagatggtctgggtttctcccctaacttaattgttccctggaataaaaattccaccatttcaagggctagggatttttttttctttttctttctttttttttttttttgagatggagtctcactctgtcgcccaggctggagtgcagtggcacaatctcggctcactgcaacttccacctcccgagttcaagtgattctcctgcctcaacctcctgagtagctgtgattgcaggcacgcgccacaacgctcggctaatttttgtatttttagtagagacagggtttcaccatgttggtcaggctggtctcgaactcctgaccttacgatccgcccgcctcggcctcccaaagtgctgtgattacaggcgtgagccaccatgcccagcagggctaggcatttcttcaggtaagtcctctcccaggttcccattacccttgttccaggccaggatggctagaagtgaccagggaagcaatgggccatgagctggtggccctgtgggcagtatcccgccctgccctgggccctgaagttggtggatgttgggggagtcccagcccgagcgccatttctgttccatcatctccattgtctctttggacttcctctcttttttttttgaaacagagtctcactctgtcaccaggctggagtgaagtggggcgatctcagctcactgcaaactccacctcccaggttcaagcgattctcctgtctcagcctcctgagtagctgggactacaggcacatgccaccacgcccagctaatttttgtatttttagtagagatggagtttcgccatgttggccaggctggtctcgaactcctggcctcagatgagccacctgcctcggcctcccaaagtgctaggattatagaaatgagccactgcggccagcctggacttcctcttctgagtgccctgctgacctgccctgatgatgactgttcctgcagaggtctgtgggacccccagttacctggcccctgagattatcgagtgctccatgaatgaggaccacccgggctacgggaaagaggtggacatgtgagtgcgccgggaaaggaggagcacccagctaggctgggcaagggaggaagtaggcagggctgggccggtgcccctggcgctgggtaagtggccctgggccctcgcatgtccaggtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtgagaggccaggccaactggctcctgggctcagggctgcgatgccaggcgcccctgcccggggaggccctgcctttcctgacatgctggaggggacctgccttgacattctcggttcccctctcctcctctcacaggtctcccgattcctggtggtgcaaccccagaaccgctacacagcggaagaggccttggcacaccccttcttccagcagtacttggtggaggaagtgcggcacttcagcccccgggggaagttcaaggtactaagcgtcctgatccaggcccgccagctccctaagtgcaaacctctaagccccctcctctcccaggagtccttacaccccgtgaatttccagagtacccatccctcccctcccagctgccctgtgatggcttcaaagacggcaggtgtcagcccactggctcggtccctgaggatgctggccaagtgggaagtgggggacactaggaagagccccgcagaagccacccaaggcttcgtggcaaacgagcccagagcgtccctgtgctggaggggcagggcctggcagggcgggggctgcagcccagcttctccgcctggccctgcaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttcccttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgccagcagagaaggggagagaggacagacacgtcctgagaaaaaggcctagggcttacccatcttgcctgcctcatccgcagggccggccatgatcagggagcatgagggctggggagagcatggtctggaaagaagcctggtgtgaggacaggtcctgagcctgtgccagtcctgggagaaaggggacaagaaggggctttgggacaaaaggagtcttgcaagagtagggggagggacagtggccccaagagacagcactggagagcagaaaagacagtgactaacttctatgttagcagttgacaacagctcagtagagaaaacctgtccacaagcaatgagaatatcacggccgggtgcagtggctcacacctgtaatcctagcattctgggaggccaaggcgggctgattgcttgagtccaggagtatgagacaaacctaggcagcatggcaaaaactcatctctacaaaaattagctgcacctgtagtcccagatacttgaggagctgaggtggaagaatcgctagagcctggcagtttgaggctgtagtgagctgagactgtgccactgcactccagcctggacaacagagcaagactctgtctcaaaaaaaaaaaagatttttcgtgtgcccaccagtttgaagagtcagtaagtccatgaccaccagtaatgacctactggtgtggtcattctacttccctccctttgcccacctagtggtaaggacaagaggagaaaccccataattaagatgccacacacagtctccctgggtaccaagagctggcaggagagtcacaaggtgtcctgggtccctttgcttttcatagcaagtgctgctggctttcttttttgtacccacaactgggcacaggctcagggaggtgctgggaccagctcatcacacacagacggttggtggtgtgaaggtagggacactctgggaccgggattcagacatcagcccccagctacaaggccccgtgttgcctgggaccaagccccttacctggtggtgacccgggcccggtgattggcagagccatcagctgtgtcgatccaggatgccccccggaggacgcgcatgtcctgctcagcagcctggtacggtgatgctgtccactcccacacgttccccaggaggtcatagagccctgcagccccaccggcgggtcaggccaggctgggacccgccgaccaccccgcctaccctctgaggtcctgggggccaaatggcagaagggaggtgcttccctctgcctcctctctcagacatgatggtcccaacagccagttcatgggcacagccgcaagcccaagacagctcttaccgtagttgttctgggcggggaaagcattcactggggagactccatggaagccatcctcagctttgtctcccttggggaactttccctgatgggagaaaggaagggtaaaggatttaccacctgtcccaaagcaggtcctcatgcctatccagaggaaaaccaaggtcgtcttgctgttgcatctggggaaggggaagggcacggggcggtgacctaagattcctatctagagctcccaaacccatcaccttacatccccagggtgacccccactgctggattaggaagagtgtttcccctgtacccacagggctccaggtcaagcccagcccacacctgacttctccactctcagcaacatcctgccctctgcctggaaccccacatgccacagtgcctcaagaagacaggatcctctgcatcctgcccccatgtctcatgcctgagcactgcagcctattcctgctggccttctcaggacagtgcttttttatttgcttattttagttttattttttattcacttttttttttttgaggcagggtctcgttctgtcgccaaggctagagtacagtggtagcctcactgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctagggaacacagacccttcctgccccatccccccgctttttcttttgagacagggtcttgttctgtcactcaggccagacagcagtggtgcgatcatagctcgccgcagctttgaactcctaggctcaaaggatcttcccacctcagcctcctgagtagctgggactacaggcacatgccaccaggcccagctcatttttgtatttttcggagagacagggtctccctatattgcccaggctagtcttttactcctggcctcaagcgatcctcctgccccagcctcccaaagtgttgggattacaggcataagccaccgcgcccagcccctttccaccctttaaagcccctcatgctgggcaggatggggagaagaataaaggaaaatcgccttatcatctggatacccttcaagccccctcgggcggcaaactcccactcttcctccgtgggcagtcgttttccccgccaagcacagtaggcacgggcgtcattccagctcacgtgtaacactgggtgctccagtctctctcggatgccagagccaggacctgcaggctgacagccaggattaagtgagacaggcttccgggagcgcattaagtcggaggcaggctaggtttagggcgcccgcgttcagcttttaccactagatggagcaagagagctggaagagagccgggtgagtgaccagtggtcggagtcagaaaaaagagactacaggaggctgaagggagaaatggatgggtaacaggaaacaggattcgggcaggtgaaacaggcctgctgagcgctttccctgatattcccctatccttctttgaaactcagtgttcctggatgtacgaggggtagagaggaggctgggcctggagaataagagtcaagcaggggtagaaaatgaggtagcggaatcagcccttacctgcctccaaaatgccttttccactggaagccaccagagtacagactgcgaaaaagaaggagaccgactgcaagatgctccggcccagcaaaggcacctccccgactgagccacaggacgcagaacagagacgtcaggctgagactcaggtggtctaagtgaggttgtggctgattttttttttttttttttttttttttttgagacaagatcttgctctgtcactcaggctagagtgcagtggcaccatcagagctcactgcagtctcaacctcctggactcaggtaatcctcccacctcaacctcctgagtagctgggactacaggtgtgcatgaccatgcccagctaattttcttttttttcttttttttgtagatatgggatctatgttgcccaggctggtcttgaattcttgggctcaagcaattgtcccacctcggcctcccaaagtgctggggttacaggcgtgagctgctgcgcccagctgagactggaatctttatagagcccatcttaccacccttattagaggttggcttgccaaggtgatctctctttttttttttcttttgagacacagtctcactctgtcacccaggctggagtgcagtggcgccatctcggctcactgcaacctctgccttccaggttcaagcgattctcatgcctcagcctcctgagtagctcagattacaggagcgtgccaccatgcctgtctaatttttgtatttttagtatagacggggtttcgccatgttggtcttgaactcctgacctcaggtgatccactcacctcagcctctcaaagtgctgagattataggcatgagacaccacgctcggcccaccaaggtgatctcttgattcaagttccttggatcctatcctgacttggacatttaggcaagagctaacttgggttcagggttaacttcctgggagtgtgtactgatctgacgctccatggtgagtttctcttgcttcccctctgcctccacctctcaggtctgattctccactgtgtcccaggtaacccatgtcccacaggattccctgtccaggtcccactcctatcccctcagctgcaagaccaggttctctcaccttcattggctgggtggctttgtttctcagctcatcagagacaaagtcctcaaagacaaagctccatccaaacatctcagcttctgtccgatactttttctccctgacaaaatccctataaagacatagttcagctggttcagctggtgaggttctgtgcccaccccatcttctcctgctccaggacacttcagatatccctgtcctgtaagttatacaccacagagtgttcatgattgccaaggaattaacctgaagcctgagtgattttcttttaaattagaatacaacgaattcacatacagtaaaattcactctcttcagtgtttagttctgtgaggttaattaattttttattttatttgtttgtttatttgtgtatttatttagagatggagtctcactctgtcgcccaggctggagtgcaatggtgtgatctcggctcactgcaagctccgcctcccggtttcacgccattctcctgcctcagcctcccaagtagctgggattacaggcgtctgccaccacgcccaggtaatttttgtatttttagtagtgacagggtttcaccatgttggccaggctggtctcgaactcctgacctagtgatccacctgcctcggcctcccaaagggctgagattacaggcgtgagccaccacacctgtcctatttatttatttttttgagacaaagtctcactctgttgcccaggctggagtgcagtgacacaatctcagctcactgcaacctccacctcccaggttcaagtgattctctagcctcagtctcttaagtagctgggattacagacgcataccaccacgcccagctaatttttgtattttttgtaaagatagggtttcgcaatgttagccaggctggtctcgaactcctaacttcaggtgatccacccaaagtggcctcccaaagtgttgggattacaggtgtgaggcacaacacttggccaatattttttttttttttttttgagacagagtcttgctctgtctcaaaaagactgttgcccaggctggagtgcagtggtgcaatctcagctcactgcaacctccacctcctgggttcaagcgattctcttgcctcagcttccccagtagctgggattacaggtgcacaccaccatgcccactaatttttgtctttttagtagagacgggtttcaccatgttggccaggctggtctcaaactcctgacttcatgatctgcccgcctcggcctcccaaagtgctgggattgcaggcatgagccactgtgcccaaattattttttatttaattatttatttatttatttatttatttatttatttatttatttttagacggagtctcactctatggcccaggcttgagtgcagtggcatgaactcagctcactgcaacctctacctcctgggttcaagcgataatcttgcctcagcctcctgagtagctgggattacaggtgtatgccagcacacccggctaatttttgtatttttagtagtgatggggtttcaccatgttggtcaggttggtcttgaactcctgaccttgtgatctgcctgcctcagcctcccaaagtgctgggattacaggtgtgagccactgcgcccaaccaatcatttatttttttgagaccaggtctcactctgtcacccaggctggagtgcagtggcacaatcatggcttactgtagcatcgacctcctgggttcaagagattctcgtgcctcagcctcctgatttattttaattatttatattttgagactgggtctcactctgtcacccagactgcagtgcagtggcataatcacagctcactgcagccttgacctcctgggcccaagcaattttccctcctcagcctcccaagtagctgtgactacaggtgcatgccaccatgcctagctaattttgtagagatggggtctcactatgttgcccaggctggtctaaaaattctgagctcaagtgatccacacacctcggactcccaaagtgttgggactacaggcatgagccactgtgctcagcagttctgtgagtttgacaaagcatatagtcactacaataatcaagatacagaatagttccatcggtcacctccaaaaaaatttccctgcaactcaccaaccacggaccaggtttttttgtccctatagttttgcctttcccagaacaccatataacttgaatcatacagtatgtagtcttctgggtctggcggaggtttccttcacttagcaaaaggcttctgagattcatccatgttgttgccattagtagtctgtccctttttatcgatgagtagtatcttattgtatggacataccatattttgttcatacacttaccagctgaagatcatgtgagttatctcctgtttttggagatcatgaataaagccactggagcaggagatttaagggtggggaatgtgtctcttttctgaaaggtctccagcacatcttttttttttttcttttttttgagaaaggatgtctctctgttgcccaggctggagtgcagtggtgcaatcatggctcactacagcctcaaccttccacactcaagtgatcctcctgcctcaacctccctaatagctgagactacaagtgtgtgctaccatgaagggctaatttttttttttttaatttttagtagagatgggggtctgtgttgcccaggatggtctcgaactcctgggctcaagtgatcctcccacctcagcctcccaaattgttgggattacagacgtgagccactgcatccagcccttcatcacatatctcatctcacaacaaccatcagagatagatgtaacaggtgttattgttattaactccatttaagaggtgaaaaacactgaaccaaatagaagtgaaaaattgggcttttaaaatggatttttggccgggcgtggtggctcacagctgtaatcccaacacttcaggaggccaaggcaggtggatcacctgaggtcaagagttcaagaccagcctgaccaacatggagaaaccctgtctctactaaaaatacaaaaaatagctgggcgtggtggtgcatgcctgtaatcccagctactcaggaggctgaggtaggagaatcgcttgaacccaggaggtggaggttgtggtgagctgagatcgcaccattgcactccagcctaggcaacaagaggaaaactgtgtctctaaataaataaataaatacaaataaataaaatggattttcaaggccaggcatggtgggtcacacctataatcccagcattttgggaggccacggcagaaggatcatttgagcccaggagttcgagaccagcctgggcaacagggcaaaaccctgtctctaccaaaaatacaaaacaaaataagctgggtgtgatagtgcgcacctgtagtcccaggtgatggtttgagcctgggacgcagaggctgcagcgagctgagatcataccactgaacttcagcctgggtgacagagccagaccctgtctcaaaaaaataataacaataacaataataataataaaatgaattttcatatactttggtatggtttagtaagtttcagggggcagactgtcagggtaagatggattgttatatatatgtatttatatatatatgtgtgtgtatgtatatttatatacttatttacttatttatttattttagcagagatagggtctccctatgttaccagcctggtctcagactcctgagctcaagcaatcctcccacctcggcctcccaaagtgctcacattgcaggtgtgagccagcacacctggcctataaggggaatttaaaggactctctactatgatgtcccttctcccaatcccttccccatgtagaagaggtttctgttgagtgactggcgtttgcttatatttctcagtgctatgcccagtgtaatggaaaatgcactggctcaagagcccagggatttgagttccaggccaagctcatccactaactgagagagtcagtcaaacctctttggatttcaggttcttcatctgaataacatatcccatagtacactgcaaagatgacacgtgacagtgaacaagttagttttcctttagatattaagaatgaggccaagtgcagtggctcatgcctgtaatcccagcactttgggaggctgaggtgggcagatagttgaggtcaggagttcgagcccagcctggccaacatggagaaaccccgtctctactaaaaaaatacaaaaaaaaaaaaattagccgggcgtggtggtgaacacctgtaattccagctgctcggcaggcgaaggcaggagaattgcttgaacccgggaggtggaggttgcagtgagcgagattgcgccactgcactccagcacctgggtgacagagggagtcagtctcaaaaaccaaaaaaaaaaaaaagaaagaaaaaagaatgagattagagagggtcttcattcctcctggaagaatacctgatgtacctgaaatctttgttggtgacaggaaatatgtcgatggcaaagggtttcactgtcgcctcccgcacaggcccttcaccatctctgctgtctggagaatttgttcccatcaggaatctcccaccctgcagttggaccatgctagtagcctgtccatttcctgcagagaaaaaagagagttaccagtaatacatgcatatatataaaacaagtggtaatatttggatcatatgcaatactcatgatggtataacaaaacacaacaaaaaatgtggaggcttaaaaatctggctttaaattccttttgggctgggcacggtggctcacacctgtaatcccagcactttgagaggccgaggcgggtggatgacgaggtcagatcaagaccatcctggctaacacggtgaaaccccttctctactaaaaatacaaaaaaaaaaattagccgggcgtggtggcagtcgcctgtagtcccagctacttgggaggctgaggcaggagaatggtgtaaacccgggaggcggagcttgcagtgagccgagagtgtgccactgcactccacctgggcaacagagcgagactctgtctcaaaaaaaaaaaaaaaaagaaagaaaaaaagaaaattccttttgcgttttgtttgtttggcttcacattcttgttgctgccacttaatttgctgggaaaccttaggcaaattacttaatctgagattcaatttcttgtctttttttttttttttattcgtgacaggatctcgctgtgtcacccagactggagtgcagtggtgcactctgggttcactgcaacctctgcccccgtcagctcaagcaatcctcccacctcagcctcctgagtagctgggaccacaagtgtgcaccaccacacctggctaatttttgtattttttgtagagatggggttttgttatgtcgcccaggctggtctcaaactcctgagctcaaatgatccttccacctcagcctcccaaagtgctgggattataggtgtgagccagcacgcccagctgagattcaatttcttcatctgaaaaatggggatatctatggacgaccatagcttattaataaaagaaaaaataagtatgaaaaatagggataatatctcactatctcttaggtagcagctgtatcaattaaaataacatggaaccaggagcaatggctcagagacagggtgcagaggctaaggcaggaggattgcttgagcccaggagttcaaggttgtagtgagctatcattgtgtcactgcactccagcctgggtgacagagtgagaccctgtctcaaaaaataaaaaataaaaagataataataacaataagatagcatgggtgaaatgttgaacacatggtagatttgcacttacctctttcttcctctacacaagtccttttcttcctctacacaagcccttgtcccagctaggtgaatttagacactctatcctaaaatacatctagcactttctttccatccttctgctcatgctgtttctctgcctcttcctctccacttactgaactcttatcagttcttagtgattctcaccattatatgagccagaagagaagcatataatacatatatgacagtatatccctggcctctgccataagtgcataattattgccaaatagttgaatgagcacctttagacttgtatgaatgcctcagaaaatcatagaattaaaaaggactggccaggtgcgatggctcacacctggaatcccagcactttgggaggccgaggcgggcagattacctgaggtcaggagttggagaccagtctggccaacatggcgaaaccccgtctctactaaaaatacaaaaatcagccaggcgtggtgtcaggtgcctgtaatcccagctctcaggaggctgaggcaggagaatcgcttgcacccgggaggcggaggttgcagtgagccgagatcacgccactgcactccggcctgggcgacaggagcgagactccgtctcaaagaaacaaacaaaaccaaaaataagccaggtatgatggtgtacacctgtaatcccaactactccggaagctgaggcaggagaatcacttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttattttgtccctaattcagccagcaaacgttaaaaaccatttatgagataatagatgaatctgaacagactgaatatattattaagaagcactgtcaattttttaggtgagaaacggtttgactattcaagcttaataaatccctagaataaaatgggataatgtctggacccacttccaaatggctccaggagagggggagtgtgcgattccgcaggagcaggactggccacaaactggcagctatttaagctggccgagtacgtgggggcgggggtcgttcctcgttatattctcctttttccttttttttttttttttttttttgagacggagtctcgctgtcgcccaggctggagtgcagtggcgctatctccgctcactgcaggctccaccccccggggttcacgccattctcctgcctcagcctccctagtagctgggactacaagcgcccgccatcacgcccagctaattttttgaatttttagtagagacggggtttcactgtgttagccaggatggtctcgatttcctgacctcgtgatccgcccgcctcggcctcccaaagtgctgggattacaggcgtgagccaccgcgtccggcctttttttttttttttttttttttttttttgagataaagtatcgatctgtcgcccaggctggaatgcaatggcacgatctcggctcactgcaacctccgcctcctgggttcaagcgagtctcctgtctcagcctcccgagtagctgggattacaggcacccgccgccacgcccggatagttgggtttttttgtttttgtatttttgtagagacagggtttcacgttggccaggctggtctccaactcctgacctcaagtgatccacccgcctcggcctcccaaagtgctgggattacaggctcgagccaccgcgcccggcctctctttcccttttttaggtttgaaagattccacaacaagaagttgaaaagtataaggcggtgaggcgccacgcgcaccgagagctacctccccagcctgccgctgcagccgcatcccggaagccggcagaagggcctaaggctctctcccgtcagggcggagcgccccatccccttcccagcgcccccaggatggacggccggttcactgacctagcttgagccacgcgccgaccaggagcgacagcaggggcagcagcggtaacccatgccgggccatcaggactgccgcgctgcgccgcgtacacccacggccccgctgcgcatgcgccctcatgcaccgcagcggcagtcgacccctatgcacatgcgcaggctgcgccaccacccgccccgcacccaatagttcagcagggggaaactgacggagcgaggcggaggactggccacaccaccttcaggaccgcccagggaattaaggaaaaccacgttgagggtcccggccgttccagaggccccttcactacttttctgaacctttgggacagttttcattccccttaagattgcttttgtgcgtcataccattgcaagaacagaaaggaggtttcaacttaacatttattgcacaactcacttcaggccactgctgacatcccaaaacacagcctagtaacacacaacttcaccttcaaggactgcagagatagaccaactatatataaataatctcgtggaaacgtaatttgggtgagaaaaatatgacgctagagactttgcgatgaatattttgcctaagttcagaagcttgaaaatacagttggcctacaatctcaaatttcacccaataaccgtggcccttagtcaccacaccttccatcatctttttacctctgcctgttcttgccctttacagttgcagctctctcaactcccttgcctctagttgactcctcttcccatttcctacaactttgtggcgggagcattttagcaaagccatttcaaaggcgttcaaagtccaactgatccaatgcatttactcagaaatttataccaacagggatgctttcaatattttaaattacttgagcatttatattagcataaaaattttaaaaccaaatgcttaacaatagggtagttggataatttaacatacgtccacataaaattaaaccattaaaatttgcttttcaagaaatatttaataacaaggtaagtaacatatgcttatctaacatggaattttatgtcactgctgctaaagcaaaacatcctgttcactggataaaagacctgctttatgtgtatacacttcagtgcaatttttaaaaatactataatttcagaacttccaaatttcaacagatgccagtgttctctccttttttcatatgggaaaatttctttcaaaattatttgaagcttggacaaaaattccacagctgtattcctcaggatcactttgcagtcttcaagattcagatacagaggaagcttcaattcaacctttcagagaagacattccagctcgcatgatctcatcaaccaagagaatgttggtggcaatcacagtgctgaaagggggacaaaaataagatggctcagatgattaggagccctaattcgactcaacttcccacttccaaccaagctgcacacattacatccaattaaatttcccccttcccctctacacatcagagggctagttcagtttccatacttccagctgatcacattattcatgggggaaaggagcaactaaacagagaacaccaaatgaaaaaagtatgattctctaacagtttagttttcattttcccaaacttaccaggagtgaagaagctgtttctttacacaatagttatcccatacgcctacttctgctgccaccattggctcacctaaaaggcaaccaaatcttaaaataagttcagtcagtaagaaccaacaatattgtgtgcagctttgcttatcactgatgactcatttcctccagtattaactatgagaattcaaagcttctctgttagcccaattttctactctaaaccatgacccccgtccacaatatttgatgaatgtctgacttatacttagaagtcctgaacacccctctcttcttctggatacatttctgtttactcatactgaagtatagcacttcaactataatctgactaaaatggactgatcatttccctcattccagaaaccttttctattaatgttgacaataggtcttgcacatactgcatggaggtacctgttatctcctactttgtacttaatttgtgttgttttgttacaggaacctaagatcagggctgtcaccatttcactagatttctacatccccttttctggcattaattgctatctttagctggttttcacccatgaatataatcaccacatctattttcttatcatagtacttgattaaaaactgagtaaggcaaatgcaatatgaaaatccttcaacattaatctgaaccatctaccaccactcaacatctccaaaattgtatccccaaattactcatgtctactcgtcccttaattatacctagtcattccattttttattaatatcctattttatcccattttagaacccagagttccctaacagcactggtgtcaaattgcaaagcaaaacatttttaatctttcctggcttcaactcacacgtattacatctagttttccctctacaacagttgcattctcttacctgtgttcaggtccacacccacaagctgacctgattctgaatgttctgcttgaattttaactaatgtttcctgaaggtcaaaaccagagttctgagcaagaacctaaagtaaacaaatttaattcttgagaaaacaggaactaataactgatagtaaaaaaaaaaaaaaaaaaaaaagaaaaaagaaaaagaaaatctcggcctggtgcagtggctcacgcctgtaatcccaggactttgggaggccgtggaaggtggatcacctgaggtcaggagttcgagaccagcctggccaacatggtgaaaccccatctctactaaaaataaaaaaaaacctggccgggtgtggtggcaggtgcctgtaatcccagctactcgagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaactgtctcaaaaaaaaaaaaaaaaaaaactcattgcataaagacagaacatttatgttcccttcagagaataccagacacaagttactgatcaactctctcaactaccccaaacccagcagcaatacaccagtcataaattatatatcaaaactggtatataatagaaaacaatgatatcagtctaaaacaaaagcaaaaagcaagtttgtactcaagtataacccctaatactgcaaatattaaactacaggttatctcttgccatctgcaatgtcagctattcaggcttcccagagaaaccaaatatatctggatgatgaggaatacctgttctagagtcagaaagaaaactgatcaaacttgcttatccaaaatccactttatgaataaatcctacattatcagaaaggtttgatcagctgaatcttttggaagattgactgttaaaagcatgcacaccttgggaataatgagcaatgcatcagcaaatgcttggactccaagctgtgccctgccctttacactgggcttatgtttaatcagggcttctgccattgccacttccacggcaccagcacctggaaccacacagcctgttggatgggggaaaaggaaaaatgctaagaaaactgcagaactaattatgaataacaaaatatacatatgaaagccattaatttcttacaaatttactatgacaaaatacaagtgactaacataccaaataggagaatggttcaaccagaatggcttcactagccactggcagctttcaacagatcagtattagttcatttatttgtattcacctttaataatgatatgctatgaaaaaccttagcataccatcagtcattctaaagggaagactgcttttgcatggtgtctggctgtgtaaactactgataaaaacacagtattcggccatgcctttcagaccagcaaaacaatataaaagaattgaaatacagtgaggatcttaccatcatcaatagcatttttgacagccctcaagccgtccctcactgcatctttgatctgagtgagtgtgtgcttatttggtcctttgatcaataatgtgacagaacgagggttgttacatttctcaataaaggtaaacttctcttctccctatgtgtagaaaaatatgattttcaaaaacaggatttgtgcagagtgaagagagaagagggacttacagagaatgacaagtagcatattaataaggaacaaacttgatcacattaaagcaaattatctccttttgaaaaatcacataaaagaaatgtgattttccccatcaatggcttcccattactacacataaaccttcaaaatgtatataaacaaaaatctgatcctgaatttcaattaatttttctgctaaagacttcatgaaccaggcacggtggctcatgcctgtaatctcagcactttgggaggctgagggtgaaggacagcctgagcccgggagtttaagaccagcctgggcaacacaattatgaacctgtttctacaaaaattaccaagaaaaaaaaaaaattagccagtcatggtagcacacacgtctgtggtcccacctgctcagaagcctgaggcgggaggatcacttgaacccaggaagatgaggctgtagtgaactgtgatcacaccactgcactccagcccgggcaggagtgagaccccacctcaaacaaacaaacaaaaataattcacgagctaaaaggttctattacctttaagaaaaaaatacacttaccaatgtatactcatatacaagtcctgcatgtcccaagcagtcaggacttaggtcgtcaaaagaattcagggctaccccaccacaagcaagagtcagcctgaaatagcattttaagggagatggataagcaacgttaccagtgaatttcaaagataagaccagtaatttttaggaaggaatttttcagaattacacacaaaattaaattttaaaatgtactttaagcctttccatttgccatcaaccagctaaaaactagtcttttctcttaaccctccatttaaaccactctccccaagttagcaaatgaaatctaaaaggtggacaagagctctttattagccaggcatggtggctcacacctgtaatcccaacactttgggaggttgaggtgggtggatcacttgaggccaggagtttgagaccagcctagctaacatggcaaaaccccatctctactaaaaaaacacaaagcaattcagtgggcatggtggcagacacccgtaatcccaactactcgggaggctgagaatcctatgaacccaggaagtggtagtcgcaatgaaccaagatcatgccactgcacgaaagagcaagactgtctcaaaaaataataataaaaaattttttaaaaaagctttttattgtggggagctctttggaaaaaagtatattgaattcagaaacaaaaagtaaaataatgtttacaaggggcaagggggagggagaaatggggagtaactatttaatgggtatacagtttcagtttgtgatgatgaaaaaagtcctagagatggacagtgctgacggggtgcacaatgtgaatatagttaatgccaattaactatacagttgaaaaacccaaaaataaagtataaggaaaaagaaataatcccaattcacttgcaaaatgagtaaaagtcaaattactcggatacctctccatatttctccttttagctctgcgcagagcgactatgccttcttttgaaagagcatctaaggaaaaggggtcaattccctgtaacaaaaataaaaattaatttcaacatctttcaccttaaaagtaaaaaggatgatacgtactatttagtttatacattgagttttcattctcaccttttgattaataacaacaaatcctttatctgaatcgccacagactttccttttcagttctattatttttttaaccctatcttcaatgaattttctttcagctttcacgagtttttctctctcttctgcactcttgtaaaaaaagccagaattcacttctctattaagaaaaaaaaaagttacagaaagcagggaaacattaagaaagcagcttctgaaactggattagtcctaagatttaacagttcactgagctccaatcctgccccttatgcatcttcagagactgtttcctatagctcccccaaaccaatttgagcattattgtccttacagtgggaaacaaagtttcacaaaaaagtaactcgcctaaaatacgaagcttctccatttcactgttaaggggctataaacttacgttttctcatactctaatgacacgttacaagtgaggatgtatgcatcctccacccttttcttcatatcaggatgccgtgctccgtggtccaaaacaagccctctgattaagctgtttaaacacacacaaaattatggttattgattttcagatgggtatttaatatattaaacactgaaatgagaaggtattgatatttcacgcagtcacatttttcttttttgagatgaagtctcgctctgttgcccaggatggagtgtagtggtgccatcttggctcaccgcaagctccacctcctgggttcacaccattctcctacctcagcctctcaagcagctgggactacaggcacccacaaccatgcccagctaattcttttgtatttttagtagagacggggtttcaccgtgttagccaggatggtttcgatctcctgatctcgtgatccgcccgccttggcctcccaaagtgctgggattacaggcatgagccactgcgcccggcctatttcttaaattacctgaagatcctacgctgtacagaaaagtctgcagagatggtctcactggtaggctgtcaaactgtgatgacgtcctttaaaaacatgttttctaccaagcacctgtaatcccagcacttacggaggcagaagtgagaggacaccttaatcccaggaatttaaaaccagcctgggcaacatagggagactccattctccacacagacacacacacacacacaccccaaagggaaaacaaacatgttttctaactaactctttgaaaaaaatatttttttaaattcctctactacttctcattatgctttgtacctagcaattcaataaatgccaaatgactgatgttgttcacttttcagaatcattctaaccataaacataacattcaccttatttcaggagaaaatattactaaaaacaatattctcctagcagtttatccaacttatatcttcaagtaaatatataacattttatatccaaagatatttttaaaattgccatctcacgcctgtaatcccagcactttgggaggccgaggtgggcggatcacgaggtcaggagatcgagatcatcctggttaacatggtgaaaccccgtctctactaaaaatacaaaaattatccgggcatggtggcgggcgcctgtagtcccagctactcgggaggctgaggcaggagaatggtgtgaacccgggaggcagagcttgcagtgagccgagatcatgccactgtacactccaggctgggcgacagagcaagactccatctcaaaaaaaaaaaaagccaactatctatattgtacaaagcacccctaaatttctaaacacagtttattttttgtttttgttttttttttaatgggacggggtttcgctcttgtcacccaggctggagtgcaatggtgtggtctcagctcactgcaacctccgcctcccaggttcaagctattctgctgcctcagcctcccgagtagctgggattacagtcatgcccggcacgcctggttaatttttgtaattttaatagagacggggtttccccatgttggccaggctggtctggaactcctgacctgaggtgatttgcccaccacagcctcccaaagtgctgggattacaggtgtgagcctccatgcccattagtatttcacagtcttctaccacctaccttgtatcagtttcagatttatgtttcatctccatgatctcaatcatgaagagatcaataggttcatcttgctttttaatggccaaaatggagtccactacagcctgcaattggaggagcataaccgttaagtaaattcaatttgcagcagaaacatgttgcttttcagaaggctaaagtaggcagtttcattttacaattctacactgatttaagtctttttctatcagcaaatagaatacattatatgtaaaaggcaacagctgaagtcatttacatttctgaaatctccatctataattcccaaacattaacattaattaacattaacattcctcgttttattaaaaatactggtaactggaagctttctaataaaaaaatctccactttataaaccttttaatgaaagcttcaattttacttttataacctggttaggtatactattattttaatttcctcatttttagagacacagattaggtatcattgccacaaaaatgaacctacacagcaccttgtaattgaaattggtaatcatattcatgtttctactatcagagattttctatataggtatactataccagacatagacaaaatttaatacatacctctgttaagacatctgcaagttcagcatgaactttagtacgaagagatgttctggccacatctataagtgtttccctgtccatctctctgcttactttgacttcttccaaaaactgaagggccttttcctttgcagcttcaaatccttcagtgattattctaggatgaaggccctaaaataaacacacattaacacttgcatcttcaattaggtgcaaccatagttcatgataaagttcaggtaattattgaaggagtgttctggatcatcatacctttgaacacgaggtaatataatgtgctggctttctgaatacatttaaaaggacaaatattcctttcaatgcagagcagatgaacaggtaatgaatgctctagcacagggtcaaagccaagggaactataaagcacacttgggtgttcactgtgcaaaccactctgaatcatttcaaaaccaacactgtgtcccaacaactcacagatggtagcattatcctatctttattttctttcattttttttgagatggagtttcgcacttgttacccaggctggagtacaatggcacaatctcgactcaccacaacctccgcctcctgggttcaagcaattctcctgcctcagcttcccaagtagctgggattacaggcatgcaccaccacgcctggctaatttttgtatttttagtagacacggggtttctccatgttggtcagactggtctcgaactcccaacctcaggtgatccgcccacctcggcctctcaaagtgctgggattatgggcgtgagccactgcgcctggactattctatcctttctataggtaatctcaaactaactcacatcatttactaataaaaataaagactgttctctttctccaggaaattctgacaatacattcatattcactgaggtttgctttaaccttggaactagtcagggctaaaaaagtggaatttatccaaatataagcttttggttgcctttttcctaacaaatatgcctagtcctaaacattccatttttagatctcaattattaatctacactaaagacagatgcaaatcacataggcaatgcaacttgattacaaaattattttcaggccaagaaaggttctataacctgtccaaggtcacaatttgttttagaccaggataaagacccagatttaagccccctaattctactgtatgacctcagctactattaacagcacatcaatttgtataaatatcagacacttcctatatacaaaaaaaaattacagaaacaagagttgtgcatacttcagaaatgtagagatccgcctgtttcagcagctctccaatgattaggacattagaagtcgtaccatcaccagttatatcatcctgggctgttgctacctttgctattaaggaagctgttgggtgttgaatttgctgaaagtagaaaaagaatgaatcacttaaaacaatatgaagcagtctaaatataccacagacaaaatgcaggaagggcctctttgagtgctatctacttgaaaaagctacccaaatgttggctacaaattacttcgattaactatcatgcacatgcaattataatgattgaaacgtcttcatgtgtaatttatttcccaggttatctctactttacagatgaggaagcttgaggctcagtagaagtttactcaagatgacagagctaccagttaacagtaacacataattgtacatccttgcctctttatggcaagtgtagagctctagtgagaataagccaggtatctcctaaagggcacacacattataattatttttgtaggtttgtaattttttcaaagaaaactgaaaaacagacttctggagattggagagaggttccaatgggacgagacttctgaggtggtagcaacaatttattagctacagtggtggttgtgtgtgtccattttataattatttcttaaattgtaaatgttcaatgtgcttctctctacctacgctgtatttctcacacactaaaacccaaataattttttgttttgttttggagataccctcactctgtctcctacactggaatgcagtggcacaatcttggctcaccgaaacctcagtctcccaggtttaagcgatcgattctcctgcctcagcctctgaagcagctgggactacaggcgtgcaggaccacacccggctaatttttgtatttttagctgagtcggagttttaaccatgttggccagggctggtcgtgaactcctggcctcaaatgatccacctaccttggcctgccaaagtgctgcgattacaagcataagccaccacacctagcccccaaacaattctgaagtcaagtttaactgtggctccacttttcaaacacgggccaccactgagcccactaaaaacaaaaactacacctcctaggttagcaagtccttactaaagatatttcatctggatgttgatggcatggtataccactagcaaaaccctacatattattctgaactcaaatcagcaggaaataatttccttttcttggatttgaactgctaagttttgggaatttagggatgagtaaaaagcatactcccctcaataatctaatattctccatccctaagacttgcaaagagacagatttatctcccctccagttggagatagagatgagacctaacagagaaactgctgttttaaaaagagaaaacccagctgggcacgggcctggtaatcccagcactttgggaggctgatgcggggggatcgcctgaagtcaggcgttcaagaccagcctggccaacacggtgaaatcctgtctctactaaaaatacaaaaatcaactgggcgtagtggcgcgagcctgtaatcctagctacttgggagactgagacagaagaatcgcttgaacccgggagggagaggttgcagtgagttgagattgtgccaccggactccaggctggtcgacagagcgagacttcgtctaataaaaaaaaaaaagaaaagaaaaatcatcctcatgcattttgcccatgtgattgtgtcaacctctcttaatttttcaagttttaaaataattaactttaatatacaattacagccctttagcccggactgtgaatggcaaaaaagcagggattcaaaggcagggctgtcagactccaggcactcaggactattactgattacacgccacttctgaatgttctcctaccttgaaaatggacactgcaaatctttctacaaagaaaacattctacggaaaatcaagacctttctgacctagcccagagcacctctcaccatttcgtgaagcagcacattgccgtctttagtaagtttgatgtctccagcgccagaaacgagcctgtttaaaggacagaaatgaaccagactatgactttttcaacgataactaaaagtcccattagaaaacgggcttttcccagattttagggagccagggatgtggggctagttatgtccagcaggatggaggacaggtgtagtgcccaccccgtccccgcagagattgtgccgagtcctcagggtgcctggaagccccagagggcggggaacgccgcgctctagagccgctttgttctccgcggagactgcatcgatgcgggaagaaatggccgggacggtggggcttaggagggacacaggaccgaccccggaggacgccgagaaggacggctgcgcagccccgaggcggcgggctccagtccgcggtcccgggcccgccaggtgcgcggcggcgcgcggtgcccgcccggccctccggttcagccccgccttacatcttcatggtgcccttgggccccaggttggtccttagcacgtcctgcagaccccgcgctgcgctgatgttgaccgccagcgccgcctgcgctcgggccacctcggccttggggttcagggtcttcaccgccgccatagctgctccagcggaggaaaaggaaacgatgctgagtgcccagagccggcgcggcgtggccgggaggaactatccgggtcttctggaaaagtcggcccgtctggccggcccccagcgtgcccgcgcgccgccgccattgggccacaggtcgtccggcgcccgctcattggtccgcggctgcacggctcctgcggtcccacccttcgcgcctcggccttgtcgtcatcgcgcacgggaggagcttgttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggtaaatttccaaagagctccacaattgtttccagtatccagtgtcccgccaaataccagggattcagtaacacgtggtattttactttatttattttctttttgtaaacatagggtctcactatgttgcccagggtggtctcaaactcctgagctcaagtgatactcctgagttcaagtgatcctcccgcctcggccttccaaagtgttgggattacaggcgtgagccaccgcgcccggctgtattttatttttaataaataacggaaattgttctgaattcaaaaggcaccaaagggcatgtagtgaaaattaaatcttcctcccacttctagttcaacactagagacaagcaaagttacccctgggtactctatgaattttcggaatgctttctgaatttataaacttacatatgaatataatcatttccccacacaaatggcaattcataatacacactgcagggtgtgttatactttaagtgtcttggagattgtgccatatcaagactaatgggaagtcctcggtaacagcagcgtgatgttctttgtaagaatgactcaactaggggccagggctgggtggctcacgcctgtaatcccagcactttgggaggatgaggcgggggcatcacttgtgcccgggagttcaagaccagtctgggtaacatagcgagactccatctatacaacaaatacaaaaattagccaggcgtggtggtgcacgtctgtgatcccagctacttgggaggctgaggtgggaggattgctggaatctgggaggtggaggttgcagtcagctatgatcttgccactgcacttcagcctgggctacggagctgaccctttctcaaaaagaatgacacaactaaccggtcacctactgactgatgtttaagttgttcacagtctgctattcagactgcagtgaatatctgggtatatgatgctcttaggtgggtttgtgtatttgagaatcacaaaaacatctatatatgtgactagtagcactgcacgatagaagactagttattagttccataggcattacacggtgtgcatgcggatttattataactgctgttaaaaatgttatgaggaggccaagcatggtggcgcacgcttgtaatcccagtactttgggaagccgaggtgggcggatcacttgaggtcaggagttcaagaccatcctggccaacatggtgaaaccccgtctctgtaaaaatacatcagcctggcctggtggtgtgcatctgtgatccaagctacttgggaggctgaggcatgagaattgcttgaactcaggaagcagaggttgcagtgagccgagatcatgtcactgcactccagcctgggcaacagagcgagattcctcaaaaaaaataataataataataaaggccaggtacagtgattcacacctgtaatcccagcactttgggaggcagaagcgggtggatcacctgaggtcaggagttcgagaccagcctggccaacatagtgaaacccgtctctactaaaaatacaaaaattagctgggcatggtggcggctgcctgtaatcccagttcctcgggaggctgaggcgggagaatcacttaaacctgggagttggagattgcagtgagcggagactgcattactgcactccagcctgggcaacaacagcgagacttgtctcccaggcgacatctgatggaagcatattaaatacataaataggtgttcttgataaggggaaaaaacaatttaaataacatgtataagaagttctcacttttgaaacatttcccatgggtctgtacagggaggggaacatcacacactgggacctgtcagggggtgggagcaaggggagggagagcattaagacaaatacctaatgcaagcagggtttaaaacttagaggatgggggctggacgcagtggcttatgcctgtaatcccagcactttgggaggccgaggcgggcagatcacaaggtcaggagatcgacactatcctggctaacacggtgaaacctcgtctctactaaaaatacaaaaaaaaaaattagctgggcatggtggcgggtgcgtgtagttccagctactgggaaggctgaggtgagagaatggcatgaatccaagaggcggagcttgcagtgagccgagatggagccactgcactccagcctgggcgacacagtgagactctgtctcaaagaaaaaaacaaccaccaaaaaaaccctagaggatgggttgaagggtgcagcaaaccaccatgggatatgtatacctatctaacaaaactgctcattctgcacatatatccctgaacttaaagcaaaaaaaaaaaaaaaagccaggtgtggtggcacacgcctgtaatcccagctacttgtgtggctgaggtggaattgcttgaacccaggaggcggaggttgcagtgagccagaatcacagcactgcactcccagtctcggcgacagagtgagaccttgtctcaaaaatggaaggaatttgtaaaaaacagtaagaagaattcccatactctacccacagatcccccagtgtaaacatcacatttaacccaggaataagaaattacagtgatgccggatccaatctatagatttcattcaaattttgctaattatgtcatgaatcttctatctctggcccaggattctatttatccaaaattacatttcacatttagttgtcatgttcttcagtctggaacagttctgcaatttttcagtctttaatgatcttggcatttttttgaatactggccagttattttacagactgtcccttactttagggttatttgatgtttccttatgatttttttttttttttcaaattttttaaagacagagtgttgctctttgccccaggcctggagtgcagtggcatgatctctgctcactgcagcctccgcctcctcgggttcaagtgattctcctgcctcagcctccagagtagctgggattacaggcacccaccaccatgccgggctaatttttgtacttttagtagaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctgggttcaagtgattctcctgcctcaacctcttgagtagctgggcactacaggctcccgccaccatgcccagctaatttgtgtatgtttgtagagacagggcttcaccatgttggccaggctggtctcgaacccttgacttcaggtgatttgccccctcggcctcccaaagtcctgggattacaggtgtaagccaccgtgcaaagccatcccagcacttttggaaggccaaacgtggggaggatcctttgaggccaggagttcaagaccagcctagacaacatggtgagaccccatctctacaaaaataaaacaataaaacaccgaggtgggcagatcacctgaggtcaggagttcgagaccagcctgaccatcatggagaaaccccgtctctactaaaaaaatacacaattagccaggcatgatggtgcattcctgtaatcccagctactcaggaggctgaggcaggagaatagcttgaacccaggaagcagaggttgcagtgggccaaaatagcgccattgcactccagcctgggcgacgagtgaaactttatctctaaaaaataataaataaataataaaaaccaataaaacaacaacaacaaaagcaatagattccccgagctgagtgttccttagctgtgatccaaacccaccatctttgaggcatccatctgggccacattgtgttaccccatggaagttggagggaaaggggaactgatgcaaatatcctactgcccacactgcttgctgtgctgtaagcaataaagttctttgtctctgacacaggagacttgtttctttctttttttttttttttttttgagacaaagtcttgctctgtcacccaggctagagtgcagtggcatgatcttggctcattgcagcttctgcttcctgggtttaagcgattctccttgcctcaacctcctgagtagctgggactataggcatgcaccaccacacccagctaatttttgtatttttagtagaggtggggtttcaccatgttggccaggatggtctcgatatcctgacctcatgatccacctgcctcggcctcccaaagtcctgggattacaggcctggagccaccgcgcctggccaggagtcttctttcttaggccacatccataaaacaagcaagagactaacgtattagtttgtaagtagggtaaagtcaaatctcagacctaaccatttgcaagtggtaattttctattaattttttcttttatatatttttaagagatagagtctcactctggtgcccaggctggagtgcagtggcgcaatcactgcttactgcaacctcgaccttctgggctcaagtgatccaccatcatgcctggctaatttttttgcagagacaagttctctgaaaagctatgttgctcaggctggtcttgaactcctggcctcaagtgatcctcccactttggcctaccaaattgctaggattacaggagtgagccactgcacctggccaattttctgctttcatcattcattatacatttattggttgaaattctgctgtaaggaagaactttcccttctcctccatgaatgactgactgaatgaatgaatttgtatcagtatggattcaagaattctatttttttttttttttttttgaggcagagtttcactcttgttgcccaggctggagtgcaatggcacgatctcagctcactgcaatctccacctcccgagttcaagcgattgtcctgcctcagcctcccgagtagctgggattacaggcatgcaccagcatgcccagctaattttgtatttttagtagagatggggtttctccatgttggtcaggctggtctcaaactcctaacctcaagtgatctgcctgcctggattacaagcatgagccaccacacctggccctttttttttccagtctcactgtgtcacctaggctaaataaagtgcagcggcacaatcattagctcactgcagcttttaactcctgggctcaagtgatcctcccacctcagcctcccaagtagctagcctcaagcgatcctcctgcctcagcctcccaaagtgctgggattacaggtgtcagccaccatgattgacctattatctgatttcagccagcaatattgtttttcttaatattattcttacactgttaattaaatgtgatttaaataatcttttaactctcggttattatagatgaaacagcctgcaaaaactcaccctacttcatttattccataatctttgtcctcctaatttttctattgcatcatttctgtattgtcagagtaggtaacgtttacattctgttttttctcccccaaacctgggtttatttagtcttagttttgcaatgatgtacactcaatgctcttgcttgtccctttgctgaagttccctttgctatccattggtgagtaatgtttattcattagcagtgtcctcaagaaaaatattcccatgcaagaccaggcacagtggctcatgcctgtaatcccagcactttgtgaggccaaggtggacagaccacctgaggtcaggagttcaagaccagccttaccaacatggagaaaccccgtctctactaaaaatacaaaattagccaggcgtgtattcccagctacacgggaggctgaggcaggagaatcacttgaacctacgaggctacagttgcggtgcaccaagatcgcgccattgcacttcagcctgggcaacaagacgaaactccatctcaaaaaaaaaatattctcatgggaaaaatatccccagaattcctgtatgttcaaaactatcgtttgtagcctttgtgtgtgaatgatggcttggcttgttttaaaacaaaaaaatcgctggctcataactttattcatttgtttttttgagacagggtcttgctctgttgctcaggctggagtgcagtggcatgatcacagctcactgcagcttccaccctggggctcaagctatcctcccaccttagcctcccaacaggtgtgcgccaccacgcccagtgaattttttttgttttattgtagagacaggggttggggtgggtggggggaggggtggtctcatgttgcccaggctggtctcgaactcctgacctccagtgatcctcctaccttggcctcccaaagtgctaggattacaggcatgagccaccacgcccagcctctatatctttaaatatttatttatttatttatttatttatttttagagatatggggtcttactctgttgctgaggctagccttgaactcctggcctcatgtgatcctcctacctcagcctacctagtagctgggattacaggttcaagtcaccacacccagttaaatacttatttgttctaatgtttgggttatcttcgttgaaaatttcaattgtgcatgttggctttctttggtctgtcctctacagctgtctttttttttttgagatagagtctcactctatcgcccaggctggagtgcaatggtgccatctcagctcactgcaacctccccttcccaagttcaagcaattttcatgccgcagcctcctagctgggattacaggtatgcaccacctcgcctcacaaattctaatttttgtatttttagtagagacaggtttcaccatgttggccaggctggtcttgaactcccgacctcaggtgatccaccaaccttggcctcccaaagtgctgggattacaagcgtgagccactgcaccccgccaactatcattttttctctaatttcatttaattccttttgtttatatgatttgcttttctcatttttatcatccatattggttaatatatttttcatagtgtccacttttatttgtcctctttttagcttcatattcacttctgtgatggttattttacctgttttttggagatggtgtctcaatatgtttcctaggttggatctgaacgcctaggctcaagtgatcctcctgcctcagcctcctgagtagttggcattataggcatgtgccaccatgcccagtgtgatagttatgtgttttccttctacatccttttttttttttttttccttctgagacagggtcccactctgttgccgaagctggagtgcagtggcacgaacatgtctcactgcagcctcaacctcctgggctcaagctttcctcctgcctcagcctcctgtgtagctgggaccacaagcactcgtcaccacacctggataattttttgatgttttgtagagacagtgcttcagtttgttgcctgtgctggtcttgaactcctggcctcaagcaatccttctgctttggcctcccagattgctgagattacaggtgtgagtcactgtgcccggctcccttctgcttctttcctggattttgtcagttttgtcttgccttattttgtcatgttttccatgaatctctatatttgtatttttggtttgtccttcttggaaataattcattaagttttttttcagacagatttttttttttttttttttgagacagaatctcgctctgtcgcccaggctggagtgtagggatcttggctcactgtaaacctccgcctcccggattcaagcgattctcctgcttcagcctcccaagtagctgggattacaggtgcacgacaccacaccctggtaatttttgtagttttagtagagacgaggtttcaccctgttggccaggctggtctcgaactcctgacctcaggtgatccaccagcctcggccacccaaagtgctgggattacaggcatgagccactgcgcccggtccagatctttttttttttgagacagagtctcgctctgttgcccaggctagagtgccagtggcacaatctcagctgactgcaacctctgcctcccagttcaagcagttctcctgcctcagcctcacgaatagctgggattgcaggcatgcactaccacaccgggctaatttttgtatttttattagagacagggttttgccatgttgccccagctggtcttgaactcctggtctcaagtgatctgcccacctcggcctcccaaagtgctgggattacaagtgtgagccaccgtgcccggcgcactcacacgtttctaatgtctctccatgtccaaattttctcttcttacaaggacaccggtcacattagattagggctcactctgaacacctcattttaacataatcgcctctttaaagaccttgtctccaggccagactaggtggctcatgcctgtaatcccagcacttcgggaggcctaggcgggcagatcacaaggtcaagagatcgagaccatcctggccaacatggtgaaaccccatctctactaaaaatacaaaaattagctgggcatggtggcaggcacctgtggtcccagctatttgggaggctgaggcagaagaatcgcttgaacctgggaggcagaggttgcagtgagctgagattgtgccactgcactccagcctaggccacagagcgagattctgtctcaaaaaaaaaaaaaaaaaaaaagagagagagagagagatagagtcttgctatgataatcaagctggtcttgcattcctgggctcaagcaatcctctcgccttggcctcccaaagtgtttggattacaggcgtgagcttctgtgctggccaaaacagaatgttggagacacacactgaatttacttggaaggctgattgttttcccacgccctccctaggagggtgagctgggtgttgggaccttaactctgcccataagatgttcaggccaggagagatgccctttaccccttgggttacaagggtttccactccctttctgcttgattgaggcttgccctcagttctttgtatccctgctctgctctgcttgtttcaaacaacacatttttgcactgtgtcatgaacagctcatcttcagagagtctgtttttgctggtgttttccgggatctgcatgtgcctcttcccatgtaactttggtaggccttgtgcaggtcttggagtttccagtgactttttgtcttctagtttcgttgaatatgggatttctgcctcattccccccctcaccaccatatctccctatcactttgcataatttctaggaggaggaaggggacaattcagtcaaatattgccacagttcttatactataatcatatcgctttgtaatataaatttctcccactttttccattataagattaaaaatagctcacaccaaaatcccatcgcttgaacccagaaggcagagattgtagtgtgttgagattacaccacggaactccagcctggacagagacagagccagaccctgtcccaaaaaaataaaaataaataagtaaataaataaatgaataatgtttccttttttatatagatatatagacatagatatataaccatatatcatacctggatatagacacacatagagatttctttgttcaaaaatggctcaaacgatatatacgttcttcaacttcctttattcatgtgaacatatcatgggcatatttccatggtatgacttattttgaatgccaatgtttatattaaatcacatttcaaactgtgttcactgtgttctttcaagacatttatattattttaatgtattggtatttttttttttttgatggagtcttgctctgtcacccaggctggagtgcagtggcacgatctcagctcactgcaagctctgcctcccaggttcacgccattctcctgcctcagcctcccaagtagctgggactacaggcgcccgccaccacgcccagctaatttttttgtatttttagtagatacggggtttcaccatgttagcgaggatggtctcgatctcctgacctcgtgatccgcccacctcggcctcccaaagtgctgggattacaggcgtgagctactgcgcccagccatatattgtttttttttttttaattttttttttttttttttgagacagagtctttctctgtcaccagggtggagtgcagtggtgcaatctcggcttactgcaacctccacttcctgggttcaagcgatttccctgcttcagcctcacaagtaggtgggactacaggcacgtactaccatgcccagctaattttttgtattttagtagagatgggctttcaccatgttggccaggatggtctcgatctcctgacatcgtgatctgcctgccttggcctcccaaagtgctgggattacaggtgtgagccaccgtgcccggccagcaatgtattggtatttaacgtattgataagaaatattacaattgttagcaaatattttatacacacagatataaaaagcatccgtatacctaccatcctacttaaaggaaaattattataatatcattgattaactacataccttttctcaatctcatttcctttcttactttcagaagtaactactgtcctgaattttatgttgtaaattatcatttatgacattaaatgatagtctctttttaaagtttccagtggctattggagcatcacagtaactgagaatgttcacagtactgctgtgagaattcttatatatgtgtcattttttttttttttttttttgagacagagttttgttcttgtttcccgggcgggtatgcaatggcatgatcacaggtctccgcctcccgggttccgcctcccgggttcaagcgattatcttgccttggcctcctgagtaactaggattacaggtatgcaccactacacccagctaattttgtatttttagtggagacggggtttctccatgttggtcaggctggtcttgaactcctgacctcaggtgatctgcccgcctcagcctctcaaagtgctgtgattacaggtgtgagccactgcacccagcctcatttttttcttttttttgggggacggagtctcactctgtcacccaggctggagtgcagtggcgtgatcttagcacagcctcaacctcccaggctcaagccatcctcccacctcagcctcccaagtacctgggattcgaggtgtgtgcctcgaggtgtgtgcacgtccagctaattttgtttattttttgtacagattaggtcttagtatgttgcccagggtggtcttgaactcctgggctcaagcgatcctcccacctaggcctcccaaagtgctaggattagaagcatgaggcaccacacccagcttactcatgcaagtttctcctgagtgtcttcctcaggtgggattgctgggtcatagaaattgcacgtgttcagtgttttttgtctgtttgttttttagacggagtctcgctttatcgcccaggctagagtgcagtggcgcgatctccgctcactgcaagctccgcctcttgggttcatgccattctcctccctcagcctcccaagtagctgggactgcaggcgcccaccactacgcccggctaatttttttttttttttttgtattttttgtatttttagtagagacggggtttcaccgtgttagccaggatggtttccatctcctgactttgtgatctgccctcctcggcctcccaaagtgctgggattacaggtgcaaggaaggactgagtgacagcagtgagggactgaataacaggttccaaggcataactggtgccagggtaggtgaaggaaacggaagcatcttaaactgtccaagtctctggcaagtggggctgtgggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaatttgttagcttacaaaaatgtgatctatagaaaacctttcagagctgggtaaagtggatcacacttgggcttgagcccaggagttggagaccaatgagacccagactctactaaacaaaaaccagcctggtgtggtggcacacacctgtggtccaacctactcggaaggctgaggcaggaagattgcttgagcccaggagttcgaagcttcagtgagctatgatcgtgccactgcacttcagcctgggttacagtgagaccctgcctcaaaagaaaaaaaaaaaaaggaaagaaaacctttccggaacagtagtatgacctgtattacttttgactaaccaattgtgattaaaactttgcaaaataatttgctaatatttttattacaccttcattatgctgtattgtatttggttcttatgtgctattattccagtaattatgcctttgtcttcattatgctatattgtatttggttcacatgtcctatcattccactaagaacagctatgaagctttttttttttttttttgagacagagtctggctttgtcacacaggctggagtgcagtggtgtaatctcggttcactgcaacctctgcctcccgggttcaagtgattctcctgcttcagcctcctcagtagctgagattacaggcgcctgccatcaggcctggctactttttgtatttttagttgagatggggtttcgccatgttggccaggctggtctcaaactcctgacctcaggtgatcctcccgcctcagcctccctaagtgctgggattacaggcatgagccactgtgcccggcctgatgaagcatattttaatctgtttcacagttttgccttgtctggcaagattacctcctggttgttacacttgtatgtgaccactcattagtgtcttctaggcaactatatatatatattttaatgtgatgtgctctagcaaaacaatgtctacaatacagccatctcatgctcacaagtatcaatataggtgtgaatatgaggtggattccaggaccatgaagaggtggcagattttaattaattaactaattaatttttcagagacaagggcttgctctgttacccagactggagtacagtggcatgatcacggctcactgtaacctcgaaatcctgggctcaaatgatcctcccgcctcagcctcccaagtagctgggactataggcatgcaccaccacacccagccagattttagtaaatataaatattttatctgaaatttttaagaatatttaatattttaaagaatacttaatattaaacatttatgaaatacaaataatagcataagttaactcttctagccttccacatttacttacttgagtttcttttcacctcaaacaaaataaattctgttaccacttagatacaaacatttggtgtttaacattttgtttcttttattatgctttttatttgtttatttgtgggtttttttgagatggattctcgctctgttgcccaggctggagtgcagtggcacgatctcagctcactgcaacctcctccccccacccgggttcaagcaattctcctgcctcagcctaccaagtagccgggactacaggcatgcaccaccatgccccgctaatttttgtatttttgctggagatggagttttgccatgttggccaggctggtctcgaactcctgacctcaggtgatccgcttgcctcagcctcccaaagtgctgggattacatgcttgagccaccgcgcctggccagaaaatttttaaaaagaaataggccgggcgcggtatctcacatctgtaatcccaacactttgggaggccaaggaggaaggatcgcttgagcccaggtgtttgagcccagcctgggaaacacagtgagacccccccccatctctatttaaaaacataaataaaaattaaaaataaaagtaaggtgcaaagactctcattttgttactcatggttgcattttaattaagaatataagtagtcttggccgggcgtggtggctcacgcctgtaatcccagcactttgggaggccaaggcgggcggatcacgaggtcaggaaatcgagaccatcctggctaacacggtgaaaccccgtctctattaaaaaatacaaaaaattagccgggcgtggtggcgggcgcccgtagtcccggctacttgggtggctgaggcaggagaataccgtgaatccaggaggcggagcttgcagtgagccgagatcgtgccactgcactccagcccaggcgacagagcgagactccgtctcaaaaaaaaaagaatataagtagtctttgaagttcttttgggacctacactgctgcaagcgtataatgccaaacgtggatttcaaaagaggccccccgacggagatttcactaattgctaaatcagtgcagcagtcccttgcttccctcacctatccttatcctaagtggtggtggcggcagcgcggagcagcttctgaaggtccgggagctcttttcctctgcaaagcggaggtgccacaggcaccgtgcacctctcagactgcaggggctgagcccccggaggaggagggggctggttcagggagcccctcccctggggcggggccaaatcgtcctcccagcccggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggtaagtcccggcttgtgccttccctgcgcccaactttcagattttgccgactttccttttcctcttccaggcttcctctctgagtctacatttcttcttaatcgcgtaggcagatcatttcctaaaatctccaggctttcttttcattgatttattttttgggtagcttcacttgtctaatcttacagcagctgcctgttgccaaacagcatgaatgaatgatgcaatcctacacaggagcacccttagtgcaagattggaacaatccccaaactcagagttgaagtgtccgactttgtcttctttcccattagaattagaattttaaaataagtacttaccagatacattgttataacgatacagccttaagttgggaattaaataaatcatgctttcattcattaaatatatttattatattttcttttctttttttatttttatttatttttttttttttcagacagagtctcgttctgtcgcccaggctggagtgcagtggtgtgatctcggctcacttcaacctccgcctacagggttcaagggattctcctgcctcagcctcctgagtatctgggtacccaccatcatgcctaactaattttttaatttttgtatttttagtagagacagggtttcaccatgttagccaggctggtctcaaactcctggcctcaagcgatccacctgcctccacctctgcctcccaaagtgctgggattacaggcatgaccactgtacctggtcactatattttctttatgtatgatttgcatattattactttttaaatatttgatgactgatattggaatgaggatcagggaggaaaataataaaatccaagatttctgtattaccgtgccgggtaggttttcaatatcatgaccatatagccctgtcactttcatgtcggtgaaacaaagtagtcaggacttttaaaattttcaaatgatttaatatatgcctgatacctaccctcctttccttccttcttttttttttttttaagagacagggtctcacttggtcacccaggctagagtgcagcggtgcaatcatagctcattggaatctcaaactcctgagcccaaactcctgcctcagcctcccaagtagctgggactacaaatacgcaccaccatgcctggctcatttattttattttttgtggagatggcatttcactatgttgcccaggcttatcttgaactcctgggctcaagcagtcctccctcctcggcctcccgaagtgctgggattacaggtgtgagtccccatgcccggcctttttttttttttttgagactcgctctgtcacccaggctgaagtgcagtggcacgatctcagctcactgcaagctctgcctcctgggttcatgccattctcctgcctcagcctcccgagtagctgggactacaggtgcccagtagcatgcctggctaaattttttttgtatttttggtagagacgtggtttcgccatgttagccaggatggtcctgatctgacctcgtgatccgcccgccttagcctcccaaagtgctgggattacaggtgtgagccatcatgcccgcccaagtctgcttccttgtctctgcatttagttctcctaagagattctctttccctctcccttgtctttgtaccctgctaatcaggtgtacatgatttcctatcagacttgaaccttgcagaattgaagccatagaagagtatgttgactctacagtgcttgaaggtgggtaggagtaaagcatttcccagaggaagcagtcttaggaaattttgcctctgacccatttttgtgccagtcccgccaggagagagagtgaagccagtctccctctttcctgttttgtgtatggacttcgatgttcatttcctcattctctctttctaggctcttgctcttgcagaatccacaggtctttcttgaggaaatctgtagacagaactttgtgctgcgtttttatctagggaaggaacagaagagtgtcgtctcctagaaatctagcactggagaaacgtgagtctgatttgccttttcttggttttgttttggttttttgctgtcattgtaatgttttttacgcattgaactgttacacgtttgtctatctgctagcagtttactcttttttgagacagagtcttgctttgtcgcctaggctggagtgcagtggcgcaatcttggcttactgcaacctccacctcctgggttcaagtgatatctcctgtctcagcctcctgagtagttgggattacaggtgtgggccaccacacctggctaatttttgtatgtttagtagagacagggttttgccatgttagccaggctggtctcgaactcctgacctcaggtcatccatccacctcggcctcccaaagtactgggattacaggcgtgagccactgcacccggccagcagtttactcctcacctgaattttaaaaattgatgtcaactatgtggcatgcagaagatctcagcttcccagaatagctggttatattacatatcatttcaacttttattttagctttaaggagtacatgtgcaggtttgttacatgggtatatcacatgatgctgaagtttggggtacaattgatcccatcacccagggtttgagcgcagtacccagtaggtagtttctcagtccttgccctccttcccctgccttcttgtagtcctcagttttttttgtttgtttgttttgtttgttttttttttttttgagacggagtctcgctctgtcgcccaggccagactgcggactgcagtggcggaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggcccctcagttttttgttgttgttgttttttgttttcacagagtctcgctctgtcacccaggctggagtacaatggtgtgatctcggctcactgcaacctccacctccaaggttcaagtgattctcctgcctcagcctcctgagtagctgggattacaggtgcccaccaccatgcctggctaatttttgtatatttaatagggacagcatttcaccatgttggccaggctggtcttgaactcttgatctcaagtgagttgcccgccttggcctcccaaagtgctgggattacagctgtgagccaccgcacctggccatcactgtgtgtttttcccgtctttgtatcctcatgtacccagtttagctcccacttataagtgagaacatgtggtatttggttttctgttcctgcgctaattcacttaggataacggcctccagctgcatctgtgttgcagcaaaggacatgttttcattcttttttatggctgtgctggcttttttttttaggccgggcatggtggctcacaccttgggaggccgaggtgagctcccagcactttgggaggccgaggtgagcagaactcctgaggtcaggagttcaagactagcctgtccaacatggtgaaaccccatctccactaaaaatacaaaaattacctgggtgtggtggcgcacacttctgatcccagctattcgggaggctgaggcatgagaatcacttgaacccaggaagcagagattgcagtgagccaaaatcataccactgcactccggcctgagtgacagagcaggactccatctctaaacaaaagataaaataaaatatagtgtaagtgcatgtgctggggatcccagcccttgttacagggaacctctttgactctcctctgattcagaaccttttcagaatctactgtgtattcttttttttttttttctttttttttttttgagatggagtctcgctctgtcgcccaggctagactgcagtgtggcacaatctcggctcactgcaacctctgcctcccaggtccaagcaattctcctgcctcagcctccccacgcccggctatactttgtactctttcaatgcccggggacctgaacaaatttatccctactaccaaagcaaataagcttggttctcgcaactatgcatgaccttcacaactctgtacaggcttttattttttcttacacaggtgaagataagaggtcagtcctaacaaggtgaaggaagtaaggtgatcttagaagcctcttgaaagatacagagattgagaagttgggaaagcatttctttgggcaaggaaatttttcctcttatccaaaatcagacctccgaaggctggccctgcaggaaagcttgcttttgtactttggaactagggatgagaaggccttgtcagcagtggctttttttttttttttttttttaatcagttggtcctttgcttgccaagagatgaactagctggggccagccaggcagaagttctgttctgagctgcagaaggcagtggtccggatgggacctgggagctgctgtgtctgagaatctgagaatagaccttcccaccggcatgtcttctaccctggccctgccctctccctccctgttagagccaaatacgaagaatccagagtccattctctggcaatgatttttctgtgtgtggaattctaatgtacacaatttactttgaagcaactgaccttactcagcagactttttccccctatagccacgagaattttaaatacgcatagattgtgagtcactcctggtggagacaatgaaaagaggaggaaattggccaggcttggtggctcacacctgtcatcccagcactttgggaggccgaggcaggtgaatcacttgaggtcaggagtttgagaccagcctggccaatatggtgaaaccccatctctactaaaaatacagaagaattagccaggcgtggtggcaggcgcctgtaattccagctactcaggaggcaggagaatcgcttgaacctgggaggcggaggttgcagtgagccaagatcacatcactgcactccatcctgggcaacagagtgagaccccatctcaaaaaaagtaaaaataaaaattaagaaggaggaaatcaaaagtgtacagggaggtgcaccattttgcagagcaggatgggaagagctaaaaggagctgtggccgagtttgctctgctgcccaatcaagcagggagggagttgatactcttgtaacccaatgggtgaaggccatctcccctggcctgaccgtttcatgggcagagttaaggtcctaaaatccagctcagtctcctagggagggtgtggaaaaagaatcagccttccaagtaaattcaatgtaaagtgagtctctaacattctattttggccagcatggtggcttacacttataatcccagcactttgggaggctgagatgggaggatcatttgaggccaggaattcaagaccggcctgggtaacatagtgagacctcatctctacaaaaataataataatagtaacttagctgggtgtggtggtgcgtgcctgtggtctctgctactcaggaggctgaggcaggaggatcacttcacctaggaggttgaggccacagtgagctatgattataccattggcactccagtgtgggcaacagagtgagaccttgtctctaaaaaaagccaaaaatattctgttttctccttgggaccacattacaacccaggaggcaggtgtcaacaattctgagctgtaagtcaggcctaatgttcagctggggatgtgtaaatcagttctcacttttagtggaggaaatgtacctttcctttcaaactcaaggctgatggtcttgcttttttttttttttgaggcagggtctcactctgtcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaactattgctagtgtcagtggttggaaagaggttcaagtacctggttggccttttttttttttttttgagatggagtcttgctcttgtcatccaggctggagtgcagtggtgggatctcggctcactgcaaactccacctcccgcgttcaagcaattctcctgcctcagcatcctgagtagctgggattacaggcacctgactaatttttgtacttttggccagggtggtctcgaactcctgaccttgtgattcgcctgccttggcctcccaaagtgctgggattacaggcgtgagccaccgctcccggccaaagtaactggtttttcaaacatggccagtaattatttgtctaatcatttcgacaagactggaaacctcttgaagatggcacccatgcattatgcattcctctttgggtcttgtgtcagggtccctggggactggctttgagattctggtgtccatcagtcattctcaggagcattgcccattcttagttatgttatgttgcctcatgcatcttcttttttttttttttttgtttttgagacagagttttgctcttgttgcccaggctggggtgcaatagcgcaatctcggctcgccgcaacttctgcctcccgggttcaagcgattctcttgcctcagcctcctgagtagctgggatgacaggcatgtagcaccatgcccagctaattttgtatttttagtagagacggggtttcaccatgttggtcaggctggtctcgaactcccaacctcaggtgatccacccgcttcagcctcccaaagtgctgggattacaggcatgagccaccgtgccgggccttctcatgtaccttcttaaaaagttctttagcttatcccacttacctcattttagctcctcttacaccatttgtctgtttctggcttcctcttcactcacctatggttcattctccattcttagtggacttgcactacagtaagtgctgctactctgctgatagacctgctgacttcaaggtctttacagtgagcctgcctgggcatgtagtatgaattagcttgatttctgctggaccaaagccaaatgactggtttctttttattttttatctttttttttttaatagagacagggtttcaccatgttggccaggctggtctcaaactcctagccttaagcaatcacctgtcttggctgcccaaagtcctgggaacaggcatcagccaccatgctggcccttgttgagttcttttttttttttttttttttttgagatggagtctcgctctgtcacccaggctgcagtgcagtgcagtggtgcaatctcggcttactgcaatctccatgtctccacctcccagattcaagcggttctcccgcctctccgtcccaagtagctgggattacaggtgcctgccaccatgcccggctaatttttgtatttttagtagagatggggtttcaccatgttggccaggcgggtctcgaactcctgacctcaagtgatcctcctgcttcagcctcccaaagtgctgagattacaagtgtgagccactgcagccggccccttgttgagttcttaataactgcttaggttcaactctatttaattcataaaatatttaattcatgaaacatttaactaacacctattgggtgctgggtgcagagatagaagataattcaactggagtgattgactgattttctgggttgatggggaggaaataatgtggtataagggaggccacttgatctgcacggtgaagaagtaggactttcttcatgacatgggggatatggtgattccaggcagaggagcagcatttgaaatggtgtagaggaataaaaaaacacatgacataggccgggtgcggtggctcatgcctataatcccagcacttttgggaggccaaggcaggtggattgcctgaggtcaggaattcgagaccagcctgggcaacatggtgaaaccttgtctctactcaaaatacaaaaattagctggatgtggtggcacgtgcctatagtctcaactactcagaacgctgagggaggagaattgcttgaacccgggatggggaggttgcagtgagtcgagattgcaccactgcactacactccagcctgggtgacagagcaagactccgtctcaaaaaaaaaaaagtccttagtattccttgagccataaattgtgtgtgtcaccaggcgcagttgctcacgcctgtagttccagcactttgggaggctgagtcgcatggatcattttagcccaaaagtttgagaccacccttgggcaacatggtaaaacaccatctctactaaaaatacaaaaaattagccagatatcatgcctgcctgtagtcccagctgctcaggaggctgagccagggaggcagaggttgcagtgagctgagattgcaccactgcactccagcctgggtgacagagtgaggccctaactcaaaataaaaaaaaatgtgtgtgtgtgtatgtgtgtgcatgtgcatgtgaataatgtgtgtgtgtaaaaatgtgtgtgtatgtgtatttgtgcggactgaggttggtaaaatccacaggcataggagccagatcgtgatgggcataaattatgtaataaagacattatgttaatggctgggtactgtggctctggtagggcaccggtggctcacacctgtaatcccagctctttgggaggctgaggcaggaggatcatttgaggtcaggagttcgagaccagacaggccaacatggtgaaaccccatctctactaaaaatgcaaaaattagctgggcgtggtggcatgcacctataatcctagctacttgggaggctgaggcaggagaatcacttgaacctgggaggcagaggttgcagtgagtcaagattgtgccactgcactccagcctgggtgacagagcgagactccttctcaaaaaaaaaaaaaaaaaagatttattaatagacactgaaatttgaatttcatttttatttattattattacttttgagacagggtctcactctgtcacccaggctgcagtgcagtgtcatggtcgtagctcactgcagcctcaaactcctgtgctcaagcaatccttctgcctcaccctcctgagtagctaggtctataggtgtgtgccactacacctggctaattttaaaaatacttttgtagagatgaagtcttggtatgttgcccagataggtgttgaactcctggcttcaagtaatcctcccacctcagcctcccaaagtgctagaattacaggtgtgagccactgcagccagcctgaaatttgaatttcattagtttttacatgtcaaaaaatattattcttcttttgatttttttttcaactgtttaaaatgtaaaaatcagccagtcgtggtggctcacacctgtagtcccagctactcaagaggccatgatggaaggttcacttgagcccaggagtttgaggctgcagtgagctatgatggcaccactgcactccagcctaggtgacagaatgagatcctgtctcaaaaaaagtaaagtaggccgggcgcggtggctcacgcttgtaatcccagcactttgagaggccgaggcgggcggatcacgaggtcaggagatcgagaccacggtgaaaccccgtctctactaaaaatacaaaaaattagccgggcgtggtggcaggcacctgtagtcccagctacttagagaggctgaggcaggagaatggcgtgaacccgggaggcggagcttgcagtgagcggagatcgcgccactgcactccagcctgggcgacagagccagactctgtctcaaacaaaaaaaacaaaaaaaaaaagtaaaataaaataaatgtaaaaatcattcttacttgtgagccataccaaaccaggtggcagggtggatttggcctacaagctatagtttgctgacccctgacttaaaatatttttttttccaggtcaacttaaaatggccttattctgccaactgcattggttggaaatcagttgagcagtgggttgttcaactgctttgagtctgtttttaactgcagtctattctaaatatagattacttacatcatctgtgtagccttgtatatgacatattagtctctgataggaggctggtctaggcaatcttgagggtccctttcatcctaattctagtccaaagattttctaaaaaataaaggccaggcatgggggctcatgcctgtaatcccagcaatttgggagacctaggtgggaggattgcttgagtccaggagttgaagaccattctgggcaacatagcaagacccccatctcttcaaaaaaaaatttataaattagccaagcatagtggtgcgcacctgtagtcccagctacttgggagactgaggcaggaggatcacttgagccctggatttggaggctgcagtgagtcatgattgtaccactgcactccagcatgggtgacagagtgagaacttgtctaaaaaaaaaaaaatttgttttgactctctgtcctctgcagcttctgtagcagtgtggcgttccagagtttcttcctgtaccttcaccattttcgttctccttcccaggctcaagccaggacataaaggaggcaggtcctgcgggctgtgcccttagcactcttttcttatccctctctctattctccctggactttatttgtatgagaatttctcttcttcagacagggtctcatctctgaggccccatgctggagtgcagtggcgtgatcttggctcactgcaatctccgcctcccaggttcaagagagtctcctgcctcagccttctgagtagctgggactacaggtgcacgccatcctgcccggctaatttttagttttttagtagagatggggttttgccatgttggccaggatggtcttgaactcctggcttcaagtgatgctcccgcctcagcctcccagagtgctgggattacaggcgtgagccaccgcgcccagcctcttcctggactttaatcagaccatgtcttcaactagcccctgtacattggcgacattgtgtatgtttagccctcatatttagctctgaccttttttctgaggcttaaagcctttcccagtatctggaagttaaagtctaaactccttagcctggccctaggacctgcttagtgtgaattcctgatgcacagccaggcccctgggccaagccatagggtagcttccagcaggtcatctgcttccttctccttgtctttgctcacactcctcgctctgccatcacaagcctccctccttgtctccacccccgctccctctcctcccagcacatgccaaatcgatgccctgccctttgacaacccactcagagggccacttacctgtcagattcagctcaaatacttgtgcctccttgaagccttctttttttttcttttagttagagtcagggtcttgctctgttgcccaggctggagtgcagtggcacgatctcagctcactgcagctctacctcctgggttcaagtaattctcctgcttcagtctcccaagtagctgggattacaggcgtgcaccactatgctcagctaattttttgtattattatttttagtagagacttggtctctctatgttgcccacgctggtcttgaactcctggcctcaagcaatcctcctcctgccttagcctcccaaagtgctgggattacagggatgagccactgtgcccagtctgaagccctgtttcatagataaggctaaacatttttcctgtgttcccacagagccttatgcacacctctgcttttttttttttttttttttttgagacggagtctcgctttgtcgcccaggctggagtgcagtggcgcgatcttggctcaccgcaagctccacctcccaggttcacgccattctcctgcctcagcctcccgagtgggtgggactacaggcgcctgccaccacgcccggctaatttttttatatttttagtagagacagggtttcactgtgttagccaggatgttctcggatctcctgacctcgtgatccgcccgcctcagcctcccaaagtcctgggattacaggcctgagccaccgcgcccggcctcacacctccgctttaatgcttgcttcctcactacaattaggtagaaaaaaaaaaaacaactatatatatatctaaaagaaaagaaagatggcttcaaggaggcacaggtatttgagctactcaggaggctgaggcaggagaatcacttgaacctgagtggtggaggttgcagtaagccaagatcgtaccactgccctccagcctgggcaacagagtaagactccacctaaaaaaaaaaaagaaagaaagaaagaagaaactggtgtagtgtgggaagtaaacaaaaagaaaaggaaaaaaaaatgaatctgtgagaacactcttatgtggcctgcactgactttgacacaaattagattggcttagtaggcaaggtgggatcttttcataattttatttgatgtctttaaatacatttatcttttttcttgtaggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgtagggatagcatttattcactttatgaaatgataaagactttctaaagagtgactgttttggatgaagtgctagaccctggctatggaacatttgcactaggctttttctttcattccttagagctgaatttgacatattcattcatttatataaatatttatggcaaacaaacatggataagacatgttcttagcttgatcggggaatgacaaccgtcactaactaaagaagatggcctggggggcgaggtccaagtgtccagtggctttgtgtcatggttgaaagtgtgaccttagtggttccctggaaaggttcagagtctcttggtggatcctgggtcagatcccctctctccctcctgccctcccgccctgcagctggggacctccctctgcagtcccagtcccccagtcatgcaccatgtcattttctttttttttttttcgagacggagtctcattttgtcacccaggctggagtgcagtgacccaatctcagctcactgcaacctctgcctcccagattcaagcaattctcctgcctcagccttttgagtagctgggattacaggcgcatgccaccacgctcggctaatttttgtatttttagtagagatggggtttcaccatgttggccagggtagtctcgaactcctgacctcgtgatccgcccaccttgggctaccaaagtgctgggattacaggcatgagctgctgcacccggacactatttcattttcaactgcctttcatggaagaatgcttaacctttggtctctttcttgatttatgacagctcacagcttgcaagaaaaatacctatggataggctgtgtgcctttttttttttttagatggaatcttaactctgtcatccaggctggggtgcagtggtgagatcttggctcactgcaacctctgcctcccgggttccagcaattctcctgcctcagcctcctaagtagctgggattacaggcgtgcaccaccacacctggctaatttttgcatttttttagtaaagatggggttttgtcatgttgaccaggctggtctcagactcctggcttcaggtgatctgcccacctcagcttcccaaagtgtttgggattatgggcatgagtcactgcacccagcctgttaatgttattttcaagcaatccttcaaaagtttattccaaggccttgctctcctagtagcaaagcctgtctgttgcacactgggctcttggtagcatcttccttttggtggatgtcgtgcagacccggggcagtaaggcatgttaaccttgaggacatcggacctggctggcctgactgttgggtctccctcctaggacacggcgagccatgggcggggcagtgcctttcaaagctgctctcacagagcgcttagccctcatccagccctccagggagcaggtgcagagactcatagcagagcaacccccacacctgacccccggcataaggtaagaggaaccccggctccaggtgtatttcagcaccagtgttggggggcacatcctcccaagagcatctaactattcctttagagtgccctctgggtggtttatttattttcattttcattttttaattttttaattatttttttaaattgtattttttcgagatgaagtctcactctgtcactcaggctggagtgcagtggtgaaatgtcagctcactgcagcttctgcctcccaagttcatgcaattctcctgcctcagcctcccgagtagatgggattacaggtgcccaccagcacacctaggtaatttttgtatttttagtagagatgggtttcgccatgttgaccacactgcttgaactcttgacctcaaatgatctgcctgcctgggcctcccaaagtgctgggattatagctgtgagccactgcacccggcctattattattttttttagagtcagcgtctcattctgttgcccatgttggagtacagtagtataatcatggcttactacagcgttgaactcctggggtcaagtggccctccctccttagcctccttaatagtggggactacaggtgcatgccaccatgcccagctaatttttaaaaaaaaattttttttgagagacagggtctcactttgtcacccaggctggagtgcagtggcatgaatagagctcactgcagcatcagccttctgggctcaagggatcctcctgcctcagcttcctaagtagctgggactacagacgtaggccaccatgcctaattttttttttttttaattttctgtagacacagggtctcactatgttgcccaggctggtcttgaacttgtgggctcaaatgatcaattttcccacctcagcctcccaaagtgttggaattataggtttgagccactatacccagcctttaaaatattttttgtagagatgggggtcttgctatgttgcccaggctgttctcaagctcctggcctcaagtgattttctaccttggcctcccaaactgctggatttaaaggcgtggcctgtgtggtgcttttggcacttacacgtggtcttgtctggccagttgtctggtcctgtcggtttctgcctttcctctttctccagggaaaacctaagctttccttgtttgtcctcatcttgtgtttttctgggtccatgggcagagtagagttctggaacggtttcctaaagcagacaaaccctacccattgttttttttttgttgttgttgttttttgagacagagtctcgcactgttgccaagctggtgtgcagtggtgcagtctcggctcactgcaacctccacctcccaggttgaagcaattctcctgcctcagcctcccaggtagctgggattacaggcatgtgccaacatgcccagctaatttttgtatttttagtagagatggagtttcactattttggtcaggctggtctcgaatgcctgagctcgtgatccacctgcctcggcctcccaaaatgctgggattacaggcgtgagccaccacgcccagcccctacccattgatttctaagtgcatttagaaaaacatataaggctgggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctattgctctggctgaagtgcagtggctccatctcggctcactgcaacctctgcctcctgggtgcaagcgattctcctgcctcagcctcccaagtagctgggattacaggtgcccaccaccacacctggctaatttttgtattttttttttagtagagtcggggtttcatcatgttggtcacgctggtctcaaactcctggcctgagatgatccacctgccttggcctcccaaagtgctgggattacaggcgtgagccactgtatgttaacagaacattcttgaatgatctagagatagagatcattgaaaaaagaagtcaagaatgagtgtggtaattactgtaaaaatagaaataattgataaaaaataagctggaatttcctcttgggtgacataatatattaacattttaaatttaatatattaaggctgggtgtggtggctcacgcctgtaatcccagaactttgggaggccgaggcaagtctgatcacctgcggtcaggagtttgagaccagcctggccaatgtggcaaaaccccatctctactaaaaatacaaaacttagctggtgtggtggcatgcgcctataatcccagctacttgggaggctgagacacgagaatggtttgaacctgggaggcggatattgcagtgagccgagatcacaccactgcactccagcctgggcaacagagtgagacactgtctcaaaaataaataaattaattaattaatttgatactactattttatggtgttctgccacctcaacaaggtttgagaattactggaagcttaaaggatacaacaaaattcacccaatttatttatgacctaatagagccatctctacaattgatagttataatttaaaagcaaaggttggctaggtgtgatggctcacacctgtaatcccagcactttgggaggctgaggcaggaggatcacatgagcctaggagttccagaccaacctgggcaacataccaagaccccatttctataatcataatcataatcataaaaggaaataaaagcaaagcaaagcttgtttattcccaggaacaggtgtggagctccaggctgtgtgactttaccgacggccatttttagccttctcagtgacatttaagtgaagatatcatctatgcagaaagctggcattggtcagatacttctctgggtctttaaccctatttttatttctcttttaaggtgaatatgcaggttttgatgagacgcagccaacagctgaatctggtggaaaaggaaaagtgattaaatttttaaaggaaaaatttcattttaagaaaataatcatgattggagatggtgccacagatatggaagcctgtcctcctgctgtatgtattaagggtgctaattttttttcaggttgtacttttgttttatttatttatttattatttctttattttttttgagacggagtttcactcttgttgcccaggttggagtgcagtggcgtgatctcagcttactgcaatatccgcctcctgggttcaaaccattcttgtgtctcagcctcccaagtagctgggattacaggcacacgccaccatgccagctaagttttgtatttttagtagagacaatgtttcgccacgttggccacgctggtctcgaactcctgacctcaggtgatctgcctgcttcagcctcccaaagtgctgggattacaggcatgagccaccgtgcccggccgtacttttgttttagacagctgatgcatcctatattcccaacactttgggaggtcgaggcaggaagatggcttgagcacaggagtttgagaccagcctggtcaacatagtgagaccccatctctacaaaataaataaataaaataaaataaaaacagctgatttcgaactacataagatttaaaacaggagttaacaaaaacaactctcattacaagataaaaatgaagtaataaaaacacattcaatcttgttttgtcaactttgtgcaaacccaagaaaagttgtgaataaggaactaaaaaccttttaaaacttttaacaatgccttatccccgtaggatgggcaccaccttttagcctaggtgtgtgctcaataagttgatttcatttccccaaataataccatcaacaactcataaccaagattttaatgtcattttatgctttatatactagctcctcatacattacctcatttaatcttcataacagccctgtgaagtcaaatattatgttttgttttgtttttcttagatagagtctcactctgtcacccaggctggagtgcagtggtgtgctctcagctcactgcaacctccgccctctgggctcaagtgattctcccaccttagcctcccaagtagctgggaccacagacgcattccaccacacccagctaagattttgtgtttttggtagaggcagagttatgctatatttcccaggctggtctcaaattcctgagctcaagcgatctcccctgctttggcctcccaaagtgctggtatcacaggtatgaaccaccatgcctggccaaatgttgtgttcttcttactgataggggaactgaggcttgcagagattatatgatttacctgtaacatatcagagcattttgtttttatttatttatttatttttattttttggagacagggtcttgctatgttgcccaggctggagtgcagtgttgcgatcatagcttatcacagccctgaacttctgggctcaaatgatcctcccgcctcagcctccttggtagctgggattacaggtgtgtgccactgcatcccacaccacaacagcattttattcctctgaattaatgtcattttctgagactagcagaggttttatttattttttgagacaggttcttgctctgtcacctaggccggagtgcagtggtgcaatctcagctcattgcagcctcaacgtcccagaccaagcgatcttcccatctcagcctcctgagtagctgggactgcaggcgcatgccaccacacctatctaattttgtttatgttttgtagagatgaggtctcactatgttgcccaggctaatcttgaactcctggcttaagtgatcttcctgccttggcctgccagagtgctgggattacaggtgtgagccaacatgcccggccagggattttatttctaagcattttaaaatcaatgctatatatatgtgtgtgtgtgtgtgtgtgtgtgtgtgtgtgtgtatacacatacacatatacgtatatatatgtgtgtgtgtatataaatatatacacacatatgtatatatatgtgtgtatataaatatatacatacacatatacatatatgtgtgtatatatatacatatatagtatatgtgtgtatatatataatcaaatgctatatagcaagtgtcataaatatcaaatgtgtccatttcacatagggctttgcttttgccatgtcattctaacgtaagaaaaactacaccaaaaatatagtgtggccaggagcggtggctcacgcctgtgatcccagcactttgggaggctgaggcgggaggattgcttaagcacagaggttcaagaccagctgagcaacgtggcaaaactctgtctctaaaaatttattcagggattgtggtgtgcacctgtcatcccggctactcaggaggctgaggcaggatgatcacttgagcccagaagttcaaggctgcagtgagccatgacggtgccactgcactccagcctgggtgacagggtgagactctgtctcaagaaacaaaaaaggaatgacaaaattagatgggtgcagtggagcatacctgtaatcccagcactttggaagctgacgcaggaggaggttgagagcagcctggcaacatagcaagaccctacaaaaaataaaaaaaagtagccaggcgaggtggggcacacctggagtcacagctactcaggaggctgaggcatgagaatcacttgaacccaggaggcagaggttgcagtgagtggagattgtgtcactgcactccagcctgggtgacagagcgagactccaaaaaataaataaataaataaaaataaaaatcatttctctctcttttcttccttcttaggatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggtttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtccttttttttacttcttgggatttgtcatatatgaaatgttacaaaagttttttgttttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctacaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaagatattcgaaaatcacataaagtaaaagaaataaaaacaagttttactaatcacaaaggccagcattttcccctaaatgaattaaatattaataactcctaacagcctatataaaccatttcttttttataaatgacttggaaatactcgaaagccaggtttatgtttgttttgagcagagccaagcaagggaaatttcagaacatgctttgaatgtgtgagatgctataccctccctggaggaaaaatggggggagggaaagctacggggttaacattgagaattagttgaaaaatgtatcatttaaccaaatttggccaaataattaaataattattcagccacataagcaaatcagatgaatcaaatttcctccaaatcagtttctgaaggagagacatgaaataagtttggcaccatttaaatgagattccaaacaatgaggccgttgttcccaactgtgaatacctcctggccgctctcctagaaactgttttgtggtgtttgcacttttcagtagtgccaagctctgggcaggaccaggcatgccaggaccttgaaaagtgctgcaaacggcatcagcctctgcaccgcctggtgtgcatggcaggagcaggccatgggtggacaggtgggaggaccaatcccccactggttttcactgtctgaccgtcacagctgctattgccacacgggttcttcttgcctgcggcccagagagagcccatttctcaatacaggggaattgcaatagagacagagattaattcatgcagaaccagccgaacaggaggccggagctttattcttacatcaatcaccccaaaaattcggaggctagactttttcaaggatactttggcaggccaggggattcgcttctggctggggccatggggtggggtggggtgaggtggtggggcggcaggggtggggaggtcatcggatccaggtggagctactgatggtcagaaatgcaaaaacctgggccaggcacggtggctcacgcctgtaatcccagcactttgggaggccgaggcgagcagatcacttgagatcaggagttgaagaccagcctggccaacacggtgaaactccatctctactaaaaatacaaaaattagtggggcgtggtggagcacacctgttatcccaggtacttgggtggctgaggcaggagaatcacttgaaaaactccagggggcagaggctgcagtgagcggagagatcacaccactgcactccagcctgggcgacagagtgaaactgtctcaaaaaaaaagaaaaaaagaaatgcgaaaatctgaaaagacatctcaaaaggccaatcttaggttctacagtggtgatgtaacccgcaggagtaacggggaattgcaaatcttgtgcctgccctctgga

SEQ ID NO: 14371 - DNA, 57837 bp, Human
aagttattttctttttcttttttttttttatgtttgtttctaccgctttatttttatttatttatttacttagagacactaaaaagggtatacagattttatgtgtacagctcaacgatctgtgacaaagcaaacacactccagtaaccagcatccagatcaagttacggagcgttgccaacaccctagaactcacccctcatgccctcctctaatcactgtaccttctctccactctccaaagcagtgtaacacagagattagctctgttttcaaacaagcagttggaatgatacaatgtgtacattttgtgcctgacttcctttactcaacattacgtttgtaagatttatccatgttactatgtggagctgtattagttcattttcattgttgtataatgcattatatgaccaaatgacaattatttatcctttctgccaacaaacgtgtgctgtttccaccttgggaatgttttaaatagttttgctataagcgttgttgcataccttctggtgcacatatatacacatttccattaggcatgtgtgtatatactaggagtaggatttctgggtcatagcgtatacattttcaacttctgtaaagagtaccaaccagctttcaaagtgtatgttgcaatttatgcctttatcagaaatgtatgagaattccagttgcttctcatactcaccaagacttaattttatcagatagtctttttaactttagccattctggagtatatagtactatttcaatatggttttaatatgcatttccttaattaataatgaagttttacgtttttgtcctttattggctatttgaatattcacttttataaaatgcctgctcaagtttttcacccatttttatcttgtgttgattttctaggagtcctttacatattctgtccacaacccctttgtcagttataagagtagcatacatgacttgagccacaaaatatgtgtataaatttgaaatgtaaatttcaactgatttcttacaggtttagttaccatttcagttttatagtatagaactaagctaaacaaagtattttacaaatctgtgataaataattcttaaatagaaagagtacattttttattaaaatacatcttctaaagacaagaacagggcaagttttttttttaattagctcccttatccttaaatgaataaaatacccaatgttaaaaagtcagcaagttattttcctgttgcatttggattttgactagtatacaatttttcttttctttttttttttttttttttttttttttgagaaagagtttcactcttgtcacccaggctggagtgcaatggtttgatcttggctcattgcaacctccacctcctgggttcaagcgattatcatgcctcagtctcctgagtagctgggattacaggcatgcaccaccaagcctagttaatttcttatttttcgtagagatggggttttaccatgtcagccaggctggtctcgaacacctgacctcaggtgatctgcgtgccttagcctctaaaaatgcaggtgtgcaaaaattacagatgtgatgtaaggcaaattttgcaaattgcaaattttgcaaatgcaaaaattacaggtgtgagccagtgcgcccagccatatataacattttaaatctcagctacaaagtgttttcacatacatattctcaactgatttttataatcaatttgagatgcattgtcagtttcattttacaaatggaaaaaaaggaagctgaggcaaaggtcaggcagtgaaaccaaagcatcacagccagtagatcaagctgtagggtgggatccaagtcttcgtttctctcgttctactgtgttgcagcatgctgtcaagaggatgcagtcctggtcggatctttaacaggaatgatgatggtggtgctggaattgttggccctttttctgctctgctcctatgtaacatcttcttggtttttgttcctttccctccccttctgtttctttcagcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagtggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaataatttagatgtttaaggttccttccagatcaaaagttttccaacatggagtcagtcccaggtagacatagccaggagcagagaagagggagaaaggaagaaaataccattacatccggaagcgagagatgaattttgaatccaggtggggcaaagaatgggtaggaaagttagaagctcaggaaataagcaaatttgtatcagattgaaggtaactagcactcatgtctggaaaataataactttattttttccaaatgattttaactttactccttatatcaattattcaagttttccatcagaacctcaagcagaatataaaatttatcctttattttcaaatcctttttgatttaatgtaattttcatgagatgatgaccaacttgagttgttcctcctagtgtcctctcatgcatgattacatttagccttcatgataagcctgtgaagacagccatcttacaattgccagttgaaatgaagaaacagcctccaagagctcagatggccactctagctttgcttaggccaagtcctgtctcttgggactcaaaattcccatctctcatacttcttaatgaaaattacttatggaggcttctctgagagaagtctgctaagctgccagcccaaatcttgtttaatcttttgataacagatgctcttatttgctgacctgtcctaccaagtctttcaccagtcaaatttgcatttgaattcttttttttatcttagtcatattctcagttttaccactgcatcataaaatagtcaaaaggtgggagaaggaggatggacaaaataattaaatttgaactggttctctgaaaactcaaaataagaattgattagatctctgcacatatatgtgcctgctcaatatgtgaagtacaggagaagctgctgtcaagctcagctgttggatccttaaggttgcccttggttttggtgtaagaatgtgagtttagtggttcagttccatttttgccttccacatgaaggtgccattagggtctttatgaaaatgtgcaacacaatttattcttaagccccaagggtcatcttatctttgattatctggcctagcttggagatgaccagggaaaggagggaatgtatagatccccaaatatggaaaagctcttcccccctccttactcttttttctaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtgagccttctctcttctctccttgctcacagatctctctaccactttttccctagtccctgttttctgaaggaatgggaatgcgtagtttgtggaatctcctttgtagaccaaacactacttgatctagtcgtgttatagaaaaagagattgaccgtctcattagaagtaatgcattcagagagaataatctctcttcctccttttcccctggtacctttaaaacagaagaatgttgtggaatcagagacctgattgactcctagggactttgtttgaccttgtcatttaacaaatgagaaatttgagtttagagaggtttggcaacattgatccaaacaagaggctagttgtttttgaggacagatgggacgagactcctgactgttggagcacttgcttttgctatacgattaggctgtgaagcaaatgaaggggacaaaacccaacttgtcataagtttgccattttcagtcagaaccttgcttttagattcctaacaatttcgtcacatatatattttccccacttaaattttaggatcccatgtctatcaggagggtaggatggtcttttggattgtagaccccagaagcataatatgtcggtcatcatctgagcctcagcattacatctctttcctggtagtcagcatgtgttgaatacaggctggaatattttggcctttcctcttttgagggcaaaaaatagcttatagaacttgtcccagagctaagtttgatctgaagactgcagttttcagactgtgcagtaacttctctttctttaaatcctaaatgaaacttcagcccagttttgataaccccattcaggtgtgtcctctcccctcaaagagaaaggggtatatctatttttctaaaaagcagtttggctttttggggtcttacaaatatttataccatttggcgtggcaattccattcttgtgaatatatcataaaggtataatcagaaacactgaaacaaagatataagcacaaagatcttaaacttttaacccaacatcatgtctcatagaaattgaaaataacagaaggacagttttagggaaaaactaagtaaattatggtatattcatagaatggaatattatgttgacattcaagattttatgaagtttttgattttagccaggaaagtgtttatactaggttaaaggaaaaaaacaaacaccaaactacatactttgtagaatataatcccaactctcattaaacttgagaataagactgaatggaaatatgccaaagtgacaattttttttccccagtgtggtgggatttatgtgtgggtttcttttttctttattagttttctgtactttccccaagttgtctgtactaagtacatgccacttctataacgaaacgtttagaaaaagttaaaaaagtcttgcaactcattttgcttccccttattgatttgtgtaaatcaagtttgtccatcccatgacccaggacagctttggctttgaatgcagcccgacacaaattcataaactttctgagggttttttttttttattttttttttgagacagaatttagctcttgttgctcaggctggagtgcaatggtgtgatctcagctcaccacaacttcacctcccaggttcaagcgattctcctgcctcagcctcctgagtagctgggattacaggcatgtaccaccatgcccagctaattttgtatttttactagagatggggtttctccatgttggtcaggctggtcttgaactcccaacctcaggtgatccgcccgcctcggcctcccaaagtgctgggattacaggtgtgagccaccttgcccagcgttttttgtttgtttttttagcttatcagctattattggtgtattttatgtggcccaagacgattcttcttccagtgtggctcagggaagccaaaagattggacacctatgatgtagatggtcaaaagtcaagtgaaagtcgggcagaggcaaacatcctatttgggtcttatcagactaagcctgcataaacttgaataagacaactatttactggaagcctgtctggggaaagcttcaattcccccttctttttaattaaaaaaaaaaaaatctttttatttgtacataattccaaacttttgaaaagttgcagcaacagtacaaagaatacctacatacctgtgcccacatttatctattattaacatattgctcttttgctttgtcatttgctctctctacgtaaaaaatacacctattggcccaggcgtggtggctcatgcctgtaatcccagcactttgggaggccgaggcatgcagatcaactgaggtcaggagtttgagacccgcctggccaacatggcgaaacctcgtatctactaaaaatacagtaattagccaggtatggtggcacacgcctatagtcccagtttttcgggaggctagggcaggagaatcacttgaacctgggaggcggaggttgcagtgagccaggatcgtgccgctgcactccggcctgggccacagagtgagacttcatctcaaaaaaaaaaaaaatcacatatagattttatattgtaaaatatgtattatagaatagcttattatatattatataacatgtaatatataatatataattatgtgcatatatacacatacatacatggaaaaaataatttttcttaattattttatggccttttatcccctgatactttagcatgtatttcctgacaataagactgttctcttcagaaaacatactacagttttcaaccttaataaatttagcagggttacaatcctttgcctttcatttgccaatattgtatgttgacccaataaggcccttggtagataatatacttttttttctctagtgtaggatccagtctaggatcagaattgcattaaactgccctgtaagtgcctagtcaggatatttgttctgttgcagatttacccaattagtagaaaaccatgtgaacatcctgatagataattaaatatctggaactgtcctctcattattcactttattacaaaagcaactccattcctttagtagttgcatttatagattatggtcagctacatttttaaactctcttttgcagtctggtttttaaaattcttgagaacacagcaagttgtagagtaaaaactggtccagcagcagaaagcaatttaatataatgaccttagacgttcttatgaccatggtaaccttataaactactatgcctgtgtccttaaaacaatatcctattttgtaaaaataatggaagtgccaaatcaaacaaagcctgatcctactcgtctgtgaaagcagtaccacagcaatatgcttttcaaactaaattacagtagtttcattgaggcataactatctcttccaatagtttaggcttgttcctcagatttttgcattgggatatttatatttaaggtgtttttctaaggaaagtcttttctttccaaattgctagtctcaaacatgcaaccgggtaaaatcctattacaaagagaggttctgtttagtaaagctattccaggtgctcagagaggcctctagaaacagggctttgttggtctgattgcattgagttctggccagcagataatcccgtataataagatcttttcctggtccttgtctatttcacactgaattgttcatgaggataaggtgggagggaaatggcttagccttgggttgttttctatcagaggtcttctaaaacctcacttatccctgcctaccctcagtagaacaagccatgctcctggatgccatatacatcctccaaactttgaagctaggccattggtttctgtctttcttgcgaacaaaaacctcttttattattcagctctactcatccatctttgtctaccatggacttatagtttttaaagctgaactccagaaagctacaatcctactttcatggagtcctagtattggaaacataagaggaggcctcgcatggctaggagatggaagaataaaggtgctgtggtattttgtactctttcttcctttctgaagtcagagcaattttatgtttggtaaatgttggtatatgtttggggactggactgtgatttcacgtaatgtatctatttcagcaacaggaattggaagtatcttcagaatgtttacatataaaaatatagttaagaggttgaagtgtcagccagataagaatattgttaatactcaatttgtcatgcttttatcgttttctgaaaatgtatttctttttgttgtataacctcaatgtaatggggtaagtggagggggagggtccaaaaatttcaatttaattaaaaattaaggatttatgtggattcacattaattgagaggttacgtggaaaacatttttttatttgatctgttttgtcacaaaagaacaaaagtaaagatagtagaatttaatccctatacaattggccatacattgcactgagaaaagtcaccaatgatctgcaaacagccactttgttcatttccttagagctatggaggctacaaaactgtattccagtcccaattgaaaaacagggtagctgagaacagaaaccaattgctgtttgctcattgcagtttctaatttgtgccgttactatttcccttttccttctttcttcctctccttcctcccttccctactttcctattatccttctctcccccattcttcctccctctttaactatttgcaaaaagtaggaagtcttgttctcagcaactagtgggcctagaaatttagaggggaagtttgaaaagcaggtgaggagtaggaattgccctgaaagtacttatggatgaagaagctctgcaaagtgacaataggaacaaaacatcggcagtttctggcttggatcatatttcctttttccttcagactgtgaagaaaagtgagggaaaaaaggtgagagacaaaggaattgggtatacctcgtttaaacctgctcagtttctctgctctgccttgaggagacactgtagtaagcatttgatagagacagtgatcccacttcacgtagttacctgaggcacatgccatagataggcagcatctcctttaaatcaactgcaacagggattacgaaatcagttggggcaggcattatttctcaagcagattgttttgtatcctctacagcaaaagggcaaaggtcttattctgtagaactggattctaagatgcaatttcttcattcctttagctctcgccatctgtcactgtttaactctttgtggctatgtggtttgtctccccacatagcttctaagttcttagagagaagacattgggtcttactgtatgtcccctgtgcctggaatagggcttgaggaggggtggtccagagctgagctagcacatatggtaaccactagcctcatgagctatttaatttaaaactaagattaactgaagttaaaaattcagttcctcagttgcaccagccacatcttaagtactcagtagccgcacatagcttgtggttaccatattggataggacagataaaggacattgccatcatcatacaaagttctcttggatagcactggtgtaaagcatccataaactaagtaatctacatatgcttttaaaggccagattgttttaaagacattggattggtttttttcttgttgatttatactgatgttggtgttagggatttaaacatagagaccttcaggtgggttctttatactaaattgccatagatggtaagaattatttttcagagctaaaggaagcttccataatagcactgctttaaaatatgcaaaaactgactaggaaaagattgctgacatccctcatctgatttgcttatttcaaagtgaaacacatcagcccatggacactggagagcagggtgatgccaagagagagaaccctgctaattcaaaggccaaggcagcttcgtaaatgcttaggtgctcgtgtttaactagtgtggaaatggattaaccttgtgcgtggcgttagcagacaagcatgagatgcttgtaggagtaatgtggttgggctgaagtgggagtgagggaggcacaggagatgaagcttttgggtaagaaagaagcatcatagactagaaattcataaacctgggttctaaaattctggatttgccatttcctagtcatggactctcagttaaaaccttttacttctctgggcctctgtttataatgttagaaaattttaaaaaatgcattagaatatgcagttaggaacaaagactctggagtctggtttccctttgcttaccagctgcgtgagccagggcaagttacttaaccactctgtgctttagtttcttcatgtgtaatacagggatactaatagtacacaggctgtagtgaggattacatacatgagtgtgtgcccagtgcttgggacattgctggccacatggtccacagttcacaagtgatagcagtgatgaggacgagggtgcaaacgctggagatgatgcagaggatggatcatcatcatcctcaccactgacatcatcacctccttcctctctggcagtctcagtttgtttcccgattaagtcacagaaatgaccactagcaagaaagaaacattctcctttaaaatactatacttaggggttgggcgcagtggctcacgcctgtaatcccagcactttggaggccgaggcaggccgatcatttgaggtcagtagttcaagaccagcctggccaacttggcgaaactctgtctctactaaaaatataaaattaaccaggcgtggtggcgggcgcctgtaatcccaggtactcaggaggctgaggctggggaatcactggaactcaggaggcagaggttgcagtgagccaagatcgtgccactgtacttcagcctgggcaacaagagaaaaactccatctcaaaaaaacaaaacaaaacaaaacaaaaccaaaaaaactgtacttaggtaggagcaacactgccaccttaaaggagcttattaggaagatgggtttccctccataccagatatgattattagcttaattaatttacacatgtaggcagtgctctctcaaatgggcagagcctctgagatcatcaagcaagactcttcagtggctttagacttggatataaatctatgctgtccaaaacaatattttccctaagctatctataccatgggtcagcaagttaggagatattttaagagaatctaggagatattttaggattataggctgcaactactccactctgtttgaaagtgtagtagtgtgaaagtggccagagacaccatgtaaattatgggtgtggctgtgttccaacaaagctttatttgcaagaacaggtggtttgtcctgcaggttgtcgcctaccagcatctggtctatgccatagacttgtcatctcttagcagcttcttctctttcaccttctgctggcttgcacagcttggataaacagtttgattcttggaggctttctcgaatttcaacagttcgagctcagtttttcctctagcagtaactatttctaagtctgctgaaggggtaagtaacaaaggagaaccatcagctatgagtgggagcaaaaaaggtggcagctgtccttgtattttctcttaaaaattgttctatgcttcctccatctcctaacagatgtcggctttcaccaggagactccatcttatgtatgggtccacctcacaggtgtacctgccatgtacctgctacaactcatctctttgccaaactggagccatagagaagagaggagggggtctgggagagctcaggttcaaatccattcagctactaaaaggctggatgatctcaggcaaggcactttctctctttggatctcatctttctttgtaaaatcaggagacttgaacccatcacagaagggccaccagattttgatcagtgtgacaatttatctgtgccttacctgagtgtgcctactgtcttcctggtgtctatcaggaaaaacactggcctgaggggtcctgcaatgtgctgtagggtggagaacactgcgctgccagtcagagggaagaggccaggctcaatgccaacctcatgccactgaaggattgtgtgctcactgcaacatgaaagagctttcccccaggcttttgaacgtgtgagggcaggttagtgaaaatttctatttaaattaggtcacagggttgggggaaaaccaagagaatgtgtaataactctgtgtgcttttagggagaatgtgagacatttttttttctttttttaaaattacactttaagcactagggtacatgtgcacaacatgcagatttgatacataggtatacatgtgccatgttggtttgctgcacctatcaactcatcatttacattaggtatttctgctaatgctatccttccccgagtccgccaccccccaacaggccccggtgggtgatgttccccaccctgtgtccaagtaatctcgttgttcagttcccacctatgagtgagaacatgcggtgtttggttttctgtccttgtgatagtttgctgagaatgatggtttccaacttcatccatgtccctgtaaaggacatgaactcatcttttttatggctgcatagtattccatggtgtatatgtgccacatttttttaatccagtctatcattgatggacatttgggttttttccaggtctttgctattgtgaatagtgctgcaataaacatatgtgtgcatgtatctttatagtagcatgatttataatcctttgggtgtataaccagtaatgggattgctgggtcaaatgataattctagttctagatccttgaggaatcgccacactgtcttccacaatggttgaactaatttacactcccacattaggagtgggaatataggaacataaaagcattcctatttctccacatcctctccagtatctgttgtttcctgactttttaatgattgccattctaactggagtaagatggtatctcattgtggttttgatttgcatttctctgatgaccagtgatgatgagcattttttcatgtgtctgttggctgcatagatgtcttcttttgagaagtgtctgttcatatcctttgcccactttttgatggggttgtttgtttttttcttgtaaatttgtttcagttctttgtagattctggttattagccctttgtctgatgggtagactgcaaaaattttctcccattccgtaggctgcctgttcactctgatgatagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagagtttttatggttttaggtctaacattaaatctttaatccatgttgaattaatttttgtataaggtgtaaggaagggatccagtttcagctttctacatgtggctagccagttttcccaacaccatttattaaatagggaatcctttccccatttcttgtttttgtcaggtttgtcaaagatcaggtggttatagatgtgtgtggtgttatttctgaggcctgtgttctgttccattggtctatatatctgttttggtaccagtaccatgctattttggttactatagccttgtagtatagtttgaagtcaggtagcgtgatgcctccagctttgttctttttgcttaggattgtcttggcaatgcaggccctttttttggtcccatatgaactttaaagtagttttttccaattccgtgaagaaaatcattggtagcttgatggggatggcattgaatctataaattactttgggcagtatggccattttcacaatattcattcttcctatccatgagcatggaatattcttccagttatttgtgtcctcttatttcgttgagcagtgtttgtagttctccttgaagaggtccctcacatcccttgtaagttggattcctaggtattttattttctttatagcaattgtgaatggaagttcactcatgatttggctctcatttgtctgttaatggtgtataggaatgcttgtgatttttgcacattgattttatatcctcagcttaaggagatttggggctgagatgatgggattttctaaatatatggtcatgtcatctgcaaacagggacaatttgacttcctcatttcgtaattgaataccctttatttctttctcttgcctgattgccctggccagaacttccaactttatggtgaataggagtggtgagagagggcatccttgtcttgtgccagttttcaaagggaaagtttccagtttttgcccattcagtatgatgttggctgtgggtttgtcatcaatagcacttattattttgagatacattccatcaatacctagtttattgagattttttagcatgaagcgctgttgaattttgtcgaaggccttttctgcatctattgagataatgttgtttttgtcgttggttctgtttatgtgatggattacatttattgatttgcatatgttgaaccagccttgcatcccaggggatgaagctgacttgatcatggtgaataagctttttgatgtactgctggatttggtttgcaagtattttattgaggattttcccattgatgttcatcagggatattggtctaaaattctctttttttgttgtgtctctgccaggccttggtatcaagatgatgctggcctcataaaatgagttagggaggattccctttttttctgttgattggaatagtttcagaaggaatggtaccagctcctctttgtacttctggtagaatttggctgtgaatccatctggtcctggacattttttggtgggtaggctattaattattgcctcaatttcagagcctgttattggtctattcagagattcaacttcctcctggtttaatcttaggagggtgtatgtgtccaggaatctatccatttcttctagattttctaatttatttgcatagaggtgtttatagtattctctgatggtagtttgtatttctgtgggatcggtggtgatatcccttttatcattttttattgcatcaatttgattcttctctcttcttctttattagtcttgctaatggtctaccaattttattgatcttctcaaaaaaccagctcctggattcattgattttttgaagggttctttgtgtctttatctctttcagttctgctctgattttgcttttttcttgccttctgctagcttttgaatgtgtttgctcttgcttctctagttcttttaattgtgatgttagggtgttgattttagatctttcctgctttctcatgtgggtgtttagtgctataaatttccctctacacactgctttaaatgtgtcccagagattctggtacgttgtgtctttgttctcattggtttcaaagaacatctttatttctgccttcattttgttatttacccagtagtcattcaggggcaggttattcagtttccatgtagttgtgtggttttgagtgagtttcttaatcctgagttctaatttaattgcactgtggtctgagagacagtttgttgtgatttctgttcttttatatttgctgaggagtgctttacttccaattatatggtcaattttagaaaaagtgtgatgtggtgctgagaagaatgtatattctgttgatttggggtgcagagttctgtagatgtctattaggtctgcttgttgtagagctgagttcaagtctggatatccttgttacccttctgtttcgttgatctgtctaatactgacaatggggtgttaaagtctcccattattattgtgtgggagtctaagtctgtttgtatgtctctaaggacttgctttatgaatctgggtgctcctgtatttggtgcatatatattaaggatagttagcttttcttgtcaaattgatccctttaccattatgtaatggccttctttgtctcttttgatctttgttggtttaaagtctgttttatcagagactaggattgcaacccctactttttttttgctttccatttgcttgatagatcttcctccatccccttattttgagcctatgtgtgtgtgtgcgtgtgagatgggtctcctgaatacagcacaacaatgggtcttgactctttatccaatttgccagtctgtgtcttttaattggggcatttagcccaattacatttaaggttaatattgttatgtgtgagtttgatcttgtcattatgatgtttgctggttattttgcccgttaattgatgcagtttcttcatagcatcgacagtcttcacagtttggcatgtttttgcagtggctgatactggttgtttctctgcatgttttgtgcttccttcaggagctcttgtaaggcaggcctggtggtgacaaaatctctcagcatttgcttgtctgtaaaggattttatttctccttcacttatgaagcttagtttggctggatatgatattctggattgaaaattattttctttaagaatgttaaatattgtcccccactctcttctggcttatagggtttctgccaaaagatccactgttagtctgatgggcttccctttgtgggtaacctgacctttctctctggctccccttaacactttttcctttatttcaaccttggtgaatctgacaattatgtgtcttgaggttgctcttctcgaggagtatctttgtggtctctgtatttcctgaatttgaatgttggcctgccttggtaggttggggaagttctcctggataatattctgaagagtgttttccaacttggttccattctccccatcactttcaggtacactaatcaaacgtagacttgtttttttcacatagtcccatatttcttggaagctttgtttgtgtctttttactcttttttctctaaacttctcttctcacttcatttcattaatttgatcttcaatcacggataccctttcttccacttgattgaatgggctactgaagcttgtgcatgcatcacgtagttctcatgctatggttttcagctccatcaggtcatttaaggtcttctctacactgattattctagttagtcattcgtctaatcttttttcaaggtttttgtcttccttgcgatgggttccatcatcctcctttagctcggagaagtttgttattactgatcttctgaagcctacttctgtcaactcctcaaagtcattctcctttcagctttgttccattgctggcaaagagctgtgatcctttggaggagaagatgcgctctgatttttagaattttcagcttttctgctctgatttctccccatctttgtggttttatctacctttggtctttgatgttggtgacctacagatggggttttggtgtagatgacctttttgtttatgttgatgctattcatttctgtttgttagttttccttctaacagtcaggtccctcagctgcaggtctgttggattttgctggaggtccactccagaccttgttcgcctgggtatcaccagtggatgttgcagaacggcaaatattgcagaacagcaaatattgctgcttgatccttcctctggaagcttcatccgggaggggcagctgcctttatgaggtgtctgttggcccctgttgggaggtgagtcccagttaggctatacgggggtcagggacccacttgaggaggcagtctgtcccttctcagagctcatacgccatgctgggagaaccactgctctctttagagctgtcagacagggacataactctccccagtaaaaactttcttaagttatgtgtttaccacagatcagtgcatctttgtaatttgttgggactatgtgcttaagttttacaagataatctaaaagtgatacttgtgaatggagaaaactgtcgctcatatacgggtagaggctggggttatagaaataatttatttcacttctagaaaggcaatgtccaagtctggtttcacatgcaggttataggctaagtgctctgctgggaagaaggtggctttccaggggcccaggcagcgctcttgtccacagggtatatctttagccatgacaaccacaaatttcttcctttaaaaatgcttatgagagatattaaattagagaggcattattctctgtcttagatgatatttctccctctttgttctgctgtttggtacattatctcttggttgagagttattgttatccatatgttgcattatttgcctaaagagaagctaaatggtcagtctgcccaattctgaattagttggaatttggctaaagcagggaaatacattatatgaagtaaacatgctatcctattctgaaatgagggaagtttgggataagtttgtaaccaggttcacccttaaggaatctcaaggcaaaggaaaaactagaaaataatctttacaaagacttgttattcagctgcttaacttgtgatgtttttatttaattatatatatttgaacaccatgttcaaggcactgttccaggactagggcttactaggctttagtaatatagtgtttgttttcattttattttttggaaaatttacaaattggagagcaataaagatcatgggcaatgtgtgtatgtgtgtgtgtgtgtgtttgtgtgtgtgtgtttgtgtctgtgtgtgtctgtgtgtgtgtgtttgtgtgtaagtcacggttagaggagattcacttagtccagtcctctcattatacagaagatgaagctgaggcacaggaaggaagggtgacttgcccaaagtcacatggccagtagggttagagggaagccaaggcctggctctctaattctcgagacagtgctctttatatttgacatgttgctttcctggtcaaaggactgcagggttcttctgctcagtacagaggacattctggtttgtaaacaattactcaagtttcttgaatgagaaaacacacaggcgattgcaaaaacctagaagataaataaggatattggagactgaggtttggggaagcaaaggaatgaaggaacatagccctttggcccttatcaggggcatagggtagatgaggtggggatggaaggcatgtctcagagcctgacctgctgtctctccctggatagcctggatgacaccggtaatggttcctagatgataatcaagacagaaggggaagcggtatgtgtctacctttttatgagtatcttttacttggatgatttcaggctgggggaggtgaaagaactggctgtgagataaattaggagatcttggctccaggtgaaagcaacttaaagaaatcttaaaatctttcaacacaaatgaaaccttcccacctttgccttgaagagacaaaggtgttcttctttatgcctcctttccttgaaccctcttagagacttgagcacctttctagctgcttttgacattctctgactttaactcagttttacttgaaaatgttcttgtccaggataaatctatatgaaagctcctctaggagagccttattattggtgagggaagggagagaagtaatacttcctgtttactgaatgcttatgatgttccaggcactgttctatggaatttatgtatattttcttgttgaattctcagaataaccttatgatgtcaggatcgtgccaattttacacattaggagcagtggcacagaaagataaagtaatttgactaaggccacaccacgagtcagtggggagcctggactggctctcaggcatgtggccttggatcctgagctgggaactagtgcatacactgcatctcactcttacccttccatcctttggagaaggaggagtggaggtgtggacagatgcttgaaacctagaccatcacaaatatactgttgcaacatatttctcctcaatttctacttgtttccctttctaggaccccatgatgaggagtgggggttgatggagagacatattcaagatatttatattcaaagaagcaatcaagattcagaaagatggggttgataatttttacttcaccctgggaggcagcatagtgcagtgaaaggtgagggctcatgcgtcagatatacctgggttttgaatatcagtcctgtctatgccatggtgccaggcctgtgtctcacctgtaatgtggatatgactcctatctcatgggatgtctatgcagattgaatgatataatatgtaacattgataaaattaccagcttggttgcccctttttctttcccacaaggccagggagatgagccatactggagcattcatggagagctggagtgaggcggagggacattatatctgattttcaactcaagtagaaatccgtctagggtcaaaatgtatgagtcacataggccagaagaagtggttgcagaggcaacaactgcactaggaactttgactataaaatgccttaaagattgaccagtacaagaagagtagaaaagaaaatcagagtgtgaggccaggtgcggtgactcacgcctataatctcagcactttgggaggctgaggcgggctgatcacttgaggtcaggagttcgagaccagcctggccaacatggtgaaaccccgtctctactaaaaaatacaaaaattagctgggcgtagtggtgcgtgcctgtagtcccagctactcaggaggctgaggcaggagaatcactggaacctgggaggcagaggttacagtgagccgagatctcaccactgcactccagcctgggtgacagagtgagactctgtctcaaaaacaaaaacaaaaaaaaaaaagaaaaaagaaaatcagactgtggcatgggtagtctgactctaacaatattagaggctggaaggaaggaaatttactcacacaggtctgctcttgtagggtggggagcacctgctaagttgatagggtgaagccttgggaggtgaaagaagggaatattctgtgtacaagtgaaaaagcaaacctgcttattgggagatgtgtggagtgaggcaactttggctcgggagggaagctgtgcagagggaaggaccctgtgggcctgattttactccccgtaatgataaaggtcttggattcaaatatttataatgtctcttttcatcttaaaatcctttccttcggagatgcaaaaactgaaacttgcagttgaaaacaacctacaaccaaccccttctgtattttaggattgaaattcaaatactaagttaaagtacagaccagctggcttggtggtcgaacctcttattagcataactttgatgtcccagtttgaatgtaaagactgttctttggggaaataacgctgcttaacaaacaagacataatttgcttagcatatttatttatatattgaactaagttatattttaggacttgagtttctggtgataacattttttatttcttccattctatcccttatccacaatgtactactcaagcaaagcaaatcataacatcatccttctttccctagcaagccagcaaaaatggttttactcaacaacagcccagttcagagttctaagttcttatgaatcccaacaacaggcttagaaaaaaaatgtttccttccttccccaagtgtgattcctcttttaggattggtcaaatgtgggagaatttgtctttattgggggtcgtgaacaaaacccatctcccagactctcaaccctgcagacttctccctctttctagggtaagcagtaagggccagtccaatagtgggagtcgatttgcaatgcagtgcaatcataggagtggaattgcatgtttcttatacaaagatttcctagaggtttcagtggtcaggtgacagaagttgatcaactggaagctatgctgtggatatatttgaacaatattaataaactcttcaatcaggtatcaggaataccttaagaaaactttcatctgaattattaaaaccaccatatgcagtgtttggaaatgaacaaatcaagtgtgttaggagtgatatgttacattagcactttgacactttggttttgcttaaaatgaatttatggggtgtttgctactaccggcataggcaagatcaggaggtgatttgggatgcaaagatgacataaaatgtgattactacagtatacatttttaacctttataggaaaggcttcttctgctacattgttttcacattctacttttccttaacaaagattgatatgcttcctgagtgccatgtcctgttctaagtttttataagtatcaacttcattttcataaccctatacagaaggccactattatccctattttagagatggggaaactgaggtttgaagagtaacttccccaagttcacatagctaggaagtagcagtgccaggttttaaagtcaggcactgatctgatgctagacactgtcccttaatgatcagaatctggattttcctataaattactcggtgctagaaaggtctaaccttttgtggttgatttaaaaaaacaaaacaaaacaaaacaaaacaaaaaaactgtgctcagtcaagaaaaaaattattaccttagcaaagcccagcttgttctggaataaaacgcctacaaaattgtcatcaacagtaaattttcctctgtagaaatcactcagatatcctacttgttcataaattgcttgaaatagaaaaattctaaagccagacacccaatggctgaaggctctacaaggctgttttaagaaatagaggctgtttcaagtaagtcagaggtgatggagtccttctaatctgaactcccttctgtttaacttggtgtttttctcatcaccagacagcagtggcaacagcagcagcagttgctgcaaccaaagctttccctcctttgccagatagactttttgacttaaaattccagacagtcatcctgtctgtcagcccagatttcctatgggaagtagacttgaagtgtaaacaccaggaagccaggctgaagggagcaggttattccctttaagaggctgctgtgtcctagtgttccagctatgggctgacagccgcagtcattttccagcagcggggttggactgttctcacccccgcccccatcccactgccttttccacctctgagtccaggaatgccatttccactagacaacacctttctctttaacctcttagggtgtttgaggattataaagcacccaaaactgttggcaggagaaaagcctcttatgcttgtagcctaaaaagcattatctcatgcacaaggtggccagaggcatggccttcgaccttgggagtcagagactgtgattctcctcagacccaccctctagtgactgttctctagcctttagggtgaagctattaattaattaatttattattttttgagatggagtcttgctctgtcgcccaggctggagtgcagtggcgcgatctcagctcactgcaacctctgcctcccaggttcaagcgattctcttgcctcagcttcttgagtagctgggaccaccatgcctggctaatttttgtatttttagtagagacagggtttcgccatgtcggccaagctggtctcaaactcctgacctcaaatgatccgcctgccttggcctcccaaagtgctgggattacaggtgtgagccaccgcacccggcctaaggtatttatttttaaaatgtatatttcactccatgttttaactaacagcttttaaatttaagctgtttgggatattgaaaagcaaatcagcatttctcccacataggactcaaatacaaataggaaaaaaaaatctaaaaatgtatgtccttgagtcaacctggtcaggtattatgtaagcagattttgcagaagaagaggaatttctggaattctgctgatgttcttcatgagtaactggtggctaacatggcaatgtatgtatagaattggacatattaggcttattgatgttgtgtcaaattttaacaaataggtaaattcaaatttataagtataaaaaacctcttaactatatttcaccaaatctgacacacaattaattgtgagacataccactcttttatataccactaagtagagaaaggaaataatgcaaccaaactatgaaaagacattgattaaaatatacattcaggtgtcttagaattagtaaatatggtgatctttcagctgcagtctcaccttttttccatagagtgtgacaacatgattctaatgccactgttcagttctcagttttcctctgcttggcctattggcagcaatcgacactgttgcctcccttttccttgaaacactttcttccctttgcctccaaaataccacattgtcctggttttcctcctccatcttgggctgtttcttctctgtttccatggcgggttcctcctcattttcctgacctctaaacagtggagagctccaggattcagtgcttgcacctcttttcaatgtacacactctctctcccttggtgacccacgactttaaataccatctatctgctggtaattcccaagtgcatattccagcctggaccttttacctgcactcacgatagaaatatgctcctgcctgcttggcagacccagatgtttaacaggcacctcatgcttaagatgtctaacaccaaattacaaaccatacctccacatcaattgcccatcacagaaagtggtcccctgtcttccacttgctcaggatgaaaccttagcatccttgattcctttattacattctcaccccttatttggctcattagtaaatcctgtctgtcagctctaccttcaaaatacatggagaagtccaccacctcccatcacctccatggccaccactttggcccagacccctatcacctccttgctggattactgctgtggcctctaactggttgctccatttttatctgtgctcccttcagtttattcttggcacaacagctggaatgatactgtttaaatgtaaagtcagattgtgtcatttctctccccaaggtctcccgtgactttttattgaatgcatagtagcagcttaaaggccggatgtgatctgcactctcctgactccaattttttctctctctgcgactcctcttggtccctctccctggcccacttgctccagccatgccagccttcctgctcctccttgtccatgccaatacccttcctgccattgcacctgctgctccctttgcccagaaccctctttccacagataatctgcacagctttctccattaggggcttgatgctacctctgtgaggcttctcttagatgtggcagcctcatcacctcctaccctatcctctttacctgctttatttttctccttagctctcctccctatctaacacagtttatgttttattacttccccccaatggaatgtaaccttcacaaagaaagggattttgtttcacttggcatttgttcactgccatatctcctgtacctagaaaagtgtctggcacaaagtagacgctcagtaaatttttgttgaatgaataagttaacagcttcagacatttgagatagcttcaaaaacagactaagataagcaggaaggagggatgtttttgttttgttttttgcccagtggaatgaaataaaagattatccattttcctcacagtatcagtgatatttcttccatttggaaaattgtctactgttttgatagtttatcgttggaaaacatgttgtccatttacttcaagagatctttgcacggtgttttttgttttttttctttctctttcttagtagtccccaaggttcatctgagcttacggttattgtctattaaaccttcaactagatagtgataaattctgcttcagaaataattttttgcagctaaagtaaaatctaaacagatcttctaacttttacacctcagttagggaaggactatttttaacctggggcatacaaagttcctagcactaataaagcagtttcctgtgtagtggatgcactggaagttactgctgttggtatacaaatttttaaccatgctatcgtatactggttactatgaaacacaggtacatgtgggtatgttgcttttaggagcacttactctgttattaggctggagagaccacagcttggacagctgatcccagcagaaggattttgctgcagtgggagaatctgggagaactttcctgcttatgagctctggccactaaagtggacgtagtggatcactctaaatgggaagagggcactggcagagggagaggcccttgtacaagaacagggtccctgggagcccaggtttcacccagtggtgagcataggacaccatagaactgttgtcctttcttctcattattatagaggctagagatctggcagggccacaaggctagggtgtgtgtgggcctggggccactcaggttctcagtggcttaggttacagaagctaatgagatgacgaatggtgaggagggtcagtcaagagggcagggatgacaaaaaaagactctcattcatttatccaaagatatttgtggtattcctctgacaggtgctggggatgctgctagtcaaagcagtgtggtcttgggcttggcctcaaaggcatcttggaggacaagaccattgtatgtggaacatcaattccagtaatgctaaagccaggcttttattccaatttctgactttgacatatgttgctttgtatagttgctgtatgtgctgtggccatctctgtccctgtatctgcagcttgtaaggttatggacacagtgcgtgcctgttaggagcatgtcttttagggaggtttgggggggtgttagaagggaggctgtcttgagttcatgtctcccgtcttccatgtgtacatctcaggagactgctgtgtgttgagaaactggcacagggataactgtggagttgtctgtcctgggaggaggttgtgtattaattgcctccctgggaattttctcattatttgtccctttacactctctttctagaagaataatgagaactgacattacatgtaacaagatgtgttgggggtgattgaatctttttatatgatgagtttgataccatcaaaaagtttataaacctgtctcttagatgcacccattctgcacgaagcctgattgtgcagcatgaaactgagtgctatgttgtatagttccaggcagcctttgcttcctccagctttgtcttcactgtcctttatacctcatccaaggagggctttgatatgggttctcattgatgacattcattccagatatttatctccaaaaggaaaacagccttcacattttctctaattataaaggtcaatttgggtttttattaaaagagaaggaacccatttttgcatcctgaagctgatattcagcttttaaaaaatgagcttcaaattaggattgtcccccagataatatgtaattcaaggttttatgatgcactggaaattgccatttcttccataataacccagtttatcagctcatacctcagttcttgagctctcctgctggggatcaagtcagtaccagctcacttggaagaacccattgagtactgctgtgatgccctgcatgtggcagaggcggtagcagcagcatttttccttccacataaaccctcctgtggatgacttcagccatctcctaacatgtacgtgtgaggttccaagaaacacaggaagccgggagtctggtgcttggcttcattgttcagcaccaataatcccagtgctaaaacctgtgtttgtacagaactcttcccatcttttaggttcattggcccaatgacacttgtccaagcagaaatggaggggcaggggaagcagagccgaattgtactgatatgccaccctaggagtctttaatacttgatcgcataaatctccttaaccactctaccagataagagggggtgtttctattttacttaagtgaaaagtgaaatctgagaggttgccacttgctcagggtcatgcaactaacaagtcacaaatctggagtttgaaaccatatcttgtgactactaccaatgatcttcccactacctgatccttcccatcctcatgcttttctccaggggccagggccaccttctcagatagttcctaactagtacagcctcggatgtatagggcttgactcctttgatgacctcctcagaaacttcatccattctccagagctccaggatctggcaccacgggaaaaggcaatgttggcagggcacagtggctcacacccgtaatcccagcattttgggaagcctaggaaggtggatcacttgaggccaggagttcaagaccagtctggccaacatgatgaaaccccttctctactaaaaatacaaaaattagctgggcctggtggtgcacacatgtagttctagctactcgggagcctgaggccggagaatctcttgaacccaggaggtggaggttgcagtgagccaagattgcaccactgcactccagtccagcctgggtgactgagtgagactccgtctcaaaaaaaaaaaaaggcaatgtgatgttctgtgcccctgtctatcagcccttcagtgggttgagggttgtgttacttttcaatgtaaggaaaaagacacttggcatcacatccagttaaacaatttagatcaattcaacacatagctactgtcaccaatcttgacaaaaaccctgggaactccgatggggcagatgactgggcatcctgccaagcagagaggtggtctccatgtcacttactgtcatttcacattgaggttaataattggggtgggaactttcattgtcttctgagtgtggtttcttttcttttaatgaaatgcttttctaaatctttatgctatttgacagtcctacccaaggtctctttaaattgctgtaattgcaggggctggtgaactacagcccgtgggccatatccagcctactttttttgtaagtcgagttttattagaacacagccacattcatttgtggtgttggtggctgctttcatgctccaacagagctgaggagtcatgacagagactgtatggttttcaaagcctcaaatatttactgctgtccttacaggaaaagtttgctgacttctttcattctctctctttttctctttcttttagggtatcatagatttaaagaaaggaaataaaggatgcagtggctcactcctatagtcccagcactttgggaagctgaggtgggcagatcacttgaggtcaggagtttgagatcagcctggccaacatggcaaaaccccgtctctactaaaaatacaaaaattagccgggcatggtgaacacctgtagtcccaggtactagggaggctgagttgggagaatctcttgaacctaggaggcagaggctgcagtgagctgagatcacaagaaaagaaataaagtccctggggaaactgttccagtgtctattaggtggtgcaaaagttactgtggtctttgccattttggtgaccaaaaaaaaaaaaaaaaccacaattacttttatttttttcttttttttgagacagttttactctgttgcttaggctggggtgcggtggtacaatcctggctcactgcaacctctgtctctcaggttcaagtgattctcctgcctcagcctcctgagtagctgggattacaggtgtgcaccaccacgcctcgctaattttttgtatttttagtagagacagggtttcgctatgttggccaggctggttatgaactcctgggtcaagggatccactcacctcagcctcccaaagaattacaggcataagccacccgtccagcccatgattacttttgcaccaacatatgcttggtcagtaataacagaccaggaggcagcacacacactgtggccagccttgagtgcgttcatcctaggctggatggccatgcctgaggagaataattccagcaaataataatgttcctccactgcatcacattccctattaaccacaattgaggcatcactaactgggtgggtgaccttgcactagtcaccaaccccaacatgcgatttccttgccaacaaaattgaacacttaaccatgtgtatttatgaagtatttataaacacatcttatatatgtgtatgttatatagatagtttaaaaaggaatagtaaaataaatctcaaataaaagtaataacatgaaaagaaaacccatttctccactgtccagcctaggaaacagaactttatgaatacctttgaaatcccttctgtgctccttccccctccccaaagaggtaactatctcaatttggcaaatcgtcctcctgcttttctctgtagttgattgttttcttttgactaacactttttcctacacaaggaaggcattcaaagccccagtctggtctcctcactggggttttgtgataatgtgctagactaaaaggttggtatcccctgagggagtcattgatttatctttgatttatcaactccacggtgggagaggacagcagtgaagaacattggcgaccccagccagttcatggagttgactccatgttttcatagtagagaatctagctgagagagagaacaagatgaaacctgatttgtaggccttaaatttagcttccagtccattttagtttagggaaatttcattgtatctattctttgtgggtttttttttctttttttctttattttgtggcttaaaaaaaggataaatacagtactgggttttggaaggaggggttgttaaacttaaaccttttaaactctgtaattacttcgtaaaggccgtgtatttgcatctgaaatgcattgagccttaagtttagtcctctgtgtatggagctttcataatgatgggaacacttccaaaaataaagtaactctatagaaaatgttaatcagcttatccgcagtgaccctagtgagtttctccattgtacacatgaggaaatggacatgacagttagaggtttgcccaaagccactgtcatcggcattatgaagatttaagcaatggtcctacttaccagaaaacatggtcatgttttcatgtaagacactgtggaccttagtcaaattgatctaaattaagattcagggactaacaagacttttggtgtttggaagagtctaccacatcaatcacaaagagctggcttattccttaaagttacctgcagggtttaaaatcagttatgggttttctgaggagtctatttgcttgaaatcaaaagctctgtatctgactaaacattgctcggaaaactgaaaaggacttggttcaagtaacttcacactgccagggaaaactgtgtgagaagtacagtaatgactcaatttgtggcatcctttttaaattttttgtggcattctactttttttgagatagagtctccctctctcacccaggctggagtgcagttgtgtaatcttggctcactgcaacctcccctctggggctcaagcaatcctcccacctcagtctcccaagtagctgggaatataggcctatgccaccacacccagctaatttttgtattttttgtagaaatgggttttcaccatgttgcccaggctggtctcaaactcctggactcaagcgatccacctgcctcaacctcccaaagtgctgcattacaggtgtgagccaccctgcccatccattctacttttatagttgacaggaaaacagccttctactaggaactgatttttgaaaaccattttcagtggattggtgcagaatgtgtatacagtcttccacatcatctgcctcaataggattgcctggcaaagtaagaatgcgtgttgaggagccacagcgtccttcgtttttacagaaacttttataattattattgtttttattagcaataattgatagctcattttataaatattttcctgaacaactgatgggtgcaaaaaatatttttattttttttctaggaaacctttgattgagaaatcagaacagtaaacccctctttattcttctcttttcctttctctcctaagcctcacttgggaatgtgaccctatttttttttattgagtagtaaatattttttaagatattgttaactataacagctatgttatcagggcaggtgagcgtgacctcattcaaagacatgatattggccaggcatggtggctcacgcctgtaatcccagcactttgggaggccaaggcaggcagatcacctgaggtcaggagtttgagaccagcctggccaacactgatgaaacctcatctctactaaaaatacaaaaattagctgggtgtggtggtgggtgtctgtaatcccagctacttgggagggtgaggcaggagaatcccttgaactcgagaggttaaggttgcagtgagccgagatggcaccattgcactccagcctagctgacaagagcaaaacttcatctcaaaaaaacaaaaaaaaaaaccaaagacatgacattgattcagaggactcactcacccgttgtagtaaaataccagggcccttactataagggtgatatatgcatcccacatgtaaatcctggcaaagccaatgtgtaattgcagagagaagacgccataaacagagagacaccaaagtgagctactcagggagagcctcccctcacgaacggttggtgccaggtgcttatcctgagtttttggatcttgagatttgatttttgcatttcaccaatttcatcatcaccatttcatctgttcatcagatctggggaccacagatgcacactcactgggttttcaagtgactgctgagccaggatgataatatattgaatcattggggacagctgtctgtcagactaaccagccatagtcattataagccaaggcatttccttcatcttggaaggtaccatcgatactgtcacatttcatagtggttacacatacaggatttgaattacaaaactggtgagttgggttcaataaccaactcacctacctttgtgatactgggccagtagcctaacttttctaagtgtattttttttcttacctgtgtaattggaatattaatgccttataaagatgttcagtgagctaatgccttaacataatacctggaagataatagctattgttattatacagtcattttggctgctgtcttcattataactatgcaagccaagttggaagactgaataatgaattagaaaattgcttgttgaacatgaatttgagcacaacttaggtgttcttcaggaatgcttctattggcctggaacagctgggcacactgttagttgatataaaggacaccattcccagaatttgaaaaccttttacctagacagttctgggtaaagtccattacagttttaatttgcagcttccctttttctaaatgtcatgaagtcaccatgtttttagatgggagcctctaacttacttggttactattgtatttagtacagtagtcctcccttatccacagtttagctttccaaggtttcagttgcctgtggtccactgtggtccgaaaatactaaatgggaaattccagaaataaacaattcataagttttagattatgcactattctgagtaatgcgatcaaatctcacattcccgtaccatcctgctctgtcctgctggggaagggaatcatccctttgtccaccatatccatgctggagacctcacctgcctgtgagtcacttagtagccgtctaggttatcagattgactgtctcagtactggtaccacagtgcctgtgttcaagtcacccttattttacttaatattggcccaaagctcgagaggagtgatgctgataatttggatatgccagcggccataaagtgcttcctttaagtgaaaacatgaaagttccccacttaataagaaaagtcaattgtatgctgaggttgctaagatctacaagaagaaggaatcttctatccatacattgtgaagaaggaaaaagaaattcatgcgtagtatgtatagggctctgtaccatccatggcttcaaggcatccactggggatcttggaacttatccacccctctccttcaacaagggtgtattactatagtaacagaggaatcaccgtgaataccttatttgggtttggctttcgaaacatctttttgggtctgatttattataattccatgatcattccttcttctggttccacactcaggaagtgaaatttgtatgagggtaccagctagtccacaagatgagctgcttgtgccaagtgcttaagggaggcaatgcattcctttgacatacagcgataggaaagcgtgcctcttctagttcattcattaaagcagagctgccttatgtaagaagcttcccttacaagccctcatttgttttttattttttctctggtgtaggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccaggtaatggagcccttgttgtgtgtcattaccaccgacctattgcccctatgcttcaaattttatcagttgtatgggaacaaagaaaaataacatattcggtggataggcacacacacacacacacgcatacgcctgcacacacacacacacaccctaccttctaggacgggggttctcagtggccgtctattagaatcatctagaaaactttaaaaaaaaatactgatgctcagaccctacctgcagaccagtcacatcagaatctccagggggcagagcgtgaatcggtatttgtaaaagctctctttgttactccatttacaatccattttgcatgacacactttgaacaaaaccaagaaaaaatactttttactacaccgcctctcctccagagggtgtttttgtgatgtggcttatgaaggcagcattcttgcctcctgaggatgcaggtggtgctagcggcagttgatgacagaactgattctcctccttgggttgttccgtggagcacatcagatgggaactgaggggacccaggagtgtgatttctttatagctaataagccctggctttggagccagacagcgctggatttgaatcctggctctggtacatattagcttaggtgatgaagggtaagttacttcaactttccttgcctctgttattcacattttcaagtctgctatataagattaagatgagaaataaagcatataaaatgcctgactcattgaaagtgttctacaagtggtagttacgaccatgatgtaactcattttacttagcctttctttaattgtatgtacttccctgaaaggccatgaataaagttcagatttggatattgaatcatattttccacagacttcaattcaggtttcagaacatattcccaaagtaaagaaaatgctgccactaagactagataaaacccacttaagatttaaagggccggtctgtgttattattccagtggtccaaatttgttacctaaaagagctaggtagagattttttatgacatcaattcagtttactatcattctatatcacattttgtgtatcaaagtatttcattttgcatactttatacttacgtttaagtatactttatgtacttaagaagtccaaatgcttttatctttttatactgatagcgcagtaattcttgacaattgatgtaatcatttatcaggtgaatcttttatccaagtaactggataataacaatttataggtgctaattgactttgaaggtggtcttttaaagctctggcatatttttaacttctttgaagtgtggaatttcagaaaaaaatacttattaatagacccaagtgataaacattcagaggcatacaccagtgtcttatgactttctaagaaataatttaggtgtgaaatattattcacaagtaaaactaggctttaagtagctggatttgggggaaagtgagggagatgttaaccctccaattaagtaaaatggcggcagtttgaatacagggagtttagaggcaaagcattgccacgcattcttagagactggctttaaggagagagctggaagacaagcctaaggctcaaagaaggatttagatacgtgagaataagtcgcctaatgtccttgatgatgcctaaaagaaagataacatatgactgatgcaaggttaggatttggttaacccaaacctgtggtgggcccatggaaaaataagaaggtgagagtgcatgtcaaaaagagtgattcataataaaatcattaggtcaacgaatgagagaacaaagcagcttcttcctaagtgccaaactcttgtacaccttaattatttccttccccttatctcttctataataccaaaagattctaatagtagctattttttgttgtttattttttgagaacagtaatgtcaaagcactctacaactttctcgttggttctgctatagcctttgagttatgatggaggctgagaaggcaatattaaatttttgatttcacatttcaacaatatacatcaatgtctagcagcgttttggatccagctctaactctaattttaatagccaatgaacatggatttttggctgccagttcttattacaggttgagtatcctttatctgatatgcttgggactggaagtgttttagattttggattttttcagactttggaatatttgcatatacataataagatagtttggggataggtcccaaatctaaacatgaaattcatttatgtttcacatataccttacatacatagcctgaaggtaattttatacaaaattagaaaaagtgtatgcatgaagcaaagtttgtgttaagtactcatgtgtggaattttccacttgtggcattatgttggtgctcaaaaagttttggattttgaatttttggattagggatgctcaagtggtaattgcacagtatgttactctctgtccattgtttatttctgaaatttgtcccatctaacaagtgaatcagaaggcagggggcttaattgagactccttattctcatcctgtgatgggcttgtactccctgtgtatggtggtactgctggggatttggggctttgccccaggagttattggactcttaatgggtaaaaatgactattttttttcaatggtcaatgttttttctcttcataagcctgaaagtgcctatgttatgttccactaaaaggattagccctggtgtggctttttgttgcctctgtcaagaacagccggttcattattaaccatggtggcctattagccatttttaaattaaacccattcagagtctgactctttctttatctgaggtatgagctgtatttttcagcactctcttctttcaagttcaatatctaaactgaacccagccttccagaatcatagctattcttcccttctgggacatgagcatttggaataagcagcaaaacagtgggataatagttgtaagttattgcaattttaccaaagctattaaaaaacaaaacactgccctaatacagcattccagtttgtatgttatctcttttcccatccttttactttgatttttttctctgtctttatttaaaaaatgtctcttataagaagcatatatttcagatttttttcttaaatctagtctgatagcttttgataattagagaatttcagtgtgtttacatttttatgtaattatataattgctttttaaatgtaatttttaaaatgtaattactcaaatatttgggtttaaatctaccacatctttgttttcaatttgtcctctcgtctttttttatttttttctctctccatcttttcttgctttctcttggaataatcaagtatttttttcttattccatttttcctcatctgttagcttgttaatttcacattttttacttcacttttaagggatacccaagggattacaacacacatgcttaattatgagatataggcaataaatgtgtactttttaccattttacagatactacaaccttagaagactttaatcctatttatcctcctcttatacttcgcttttgttttcatgaattttaatgttacacttttaatactgctaaaaggcagagttattacagttttacacagtcaggagtcacacagatttatctgcatattgatcttttccattcttaacattcttaataccttcctcctggagcttcaacttctacctgagaaaatttttcttttgcctaaagaatacttctatgtgtaggtttccagcagtaaactctgtttttcttggtctgaaaagtgcctatttataaataaataaattgcattatttcaccttagtttttgaaggatagctggaaataaaattctagcttgccagttattttcctttagtcctttaatgcctggatttaagtttcccctgctaaccagcaaacgagaggatgtgattttatttttaaatctatatgacataacacattttgtgcacagtattataacaggcactttgggcaatgcaaagatgagtaagacaaagtcaatgccatcaaggaagcttacagttggatggaaggaagaagtttacacatacttatataatctgaaggagtaaatccaagaggttgggaggaggaatgtgctggatcgccatctaaccagccagtaaggctccgattagaacatcagtatggagacgtgtgccgggttaaatccctgtcctggcaacatagtcattttagggaccctgagtaaattacttggcctctctgcctcagtttcttcatgagacaataggaacaacatgcgtgcctgtcctatgggttactctgagaatgaggtgagtgtgacccactgtaagcatttgtcagatgttgactattaatagttgcaattatttccaggctctggaggcaagagagatggaagaatgttcctaactagctaaaactcatacacataatgggtcttttagatgctgaatactgagggtcacttagtgttgggtggggatgttcacccaattccaggactgctgaaagcaggtggccgagcaggaagtgctatctgggttcagtgccccagagctggaaatcccagctaactgtagctatgtgttgcttactgcctgagcacatgttcctaggctggctggaatgttttctctagcaagggagataatggtctgcttcctcaatagctgtcagagaaacaaaattgagcaagtgaatttctggttttccttatgatttggttttctatgtttttttttcactccccccttttattttagagcctttgtatgtgcagagagacttaaccagtgcactctttccctgcgccttggctagggtgggaggaaaggagtctgtttcttctccttaggaaaccctgggcaaacaatttctctaactctgagatttttccatttaaaatgggaattacagaacctgcccttcacactctgagtggttatcaaaattaattttgataatcaaattactgggggccatactagagtgagatattaaagtgatgctttgcagctaggttcagaagtattatatctgtggttagagtttcagcatcccttcattgcttcatgagagaaaggggtggaaaaagaaattttatagatacttaaaaaatgatggtattaaaaacaaccacaacaatttaaaataatataaattgttactttagctgtctgctttgatcagagattcacaaatgtaaaggactgatgttaaccaggaagcggagtggagaatcaatgctctacttcttatctctccttccataagattaagcagattaaaactacactataatttcacaaccagtggacccaccgccaatgttttgtggtggttgttgttgatttctatataatagaattaattattctttgttaggatattttagtcctttccagaaccacataggggacctatgtctcaggaacagagcatttgtgcacttaggcactctctctctctctactatagtagactctgtgttggatcctggatggctttgctctgtgtaatcaactcagagaatcccaacagctagagaagtactgggccttctattttggtgagagcagcactcctgcctctgctgcagagggaactacagttactgattttttgcttaccagctgcaggatgcagctgtccttatctacgggtctgactgagaccagctattttcagaaatttaatacagtgaggacgagttgaagcaaataccagctgtacattaactgttgactttttggctattcaaattagtctttgtcattaattttccaatttgtcatctcttagaaattagggatcttgtcctaagacctgaggacctaaggtaacagctaaacttgcatgtatctagcagctgccctctgctgtgttactgcagcatggagggttatttaaggtcaagttacttaattcatggggtgtgactgcaggctctggggaacttctggggtggtgaggagaagaggacattataaagggattgctgacacacatagaaccaggaacatttagtgatgcttgtgtttaaagttgtcattgcgcacaaaggagcaatgtttataaataggctttagatttttaatgacatttcaggctgttctatttattatcatagtccaaagtttcattcagttagttgacaaccttttgtcaaacaccagctgtgagcctggtactggataaagaagaaaagtggtcaatgcctttcaataactcacttgtggtgatggagacacgtgtgcaaataattataattcagtgggataagcaaatgttataatagaagtgtgcatgaggaattataagcatcagggtgaagaagtactcaacctgccaaaaaaatacatagaaagctagagcagatatatatttgtccatttgaaagtcacttaaaaaaatcagactagttttttttcaagactatattttggtcttctttcctgaaactttcacatttggtttctgcctaggaagccccacctgctttttcatattaagggcttctcaaatctttgactctgcaaagaacgtctgttttacttacatccttgttttgctcagtagcaagctttttagaaacccttaactgttctgtaatatttaaggtatagaaataaggttttaatatcccagttcatgtcacgtgctagatattgaactttgaatctccaggaactactagaaggaactgacaaattcaagaatttgactttgtctctctgaattgggtttgaattttgcttttgccactcactatgtgaccttgggcaagtcctatacagtctccaagctttgtaagtgctttgtaaagatcttgctgagaaatagaggtgagtgtaaatgcccagtcctgcacttgacatagagcagggggctcagtaaatcttagcaactattttctgtgttggaatttgaattctacattgtcctttttttgacttgacagcaaatgcattatgttttcagtaaatgcacattaagttgaaatcagcatttgctaaatatctgttgtgtcccaaacactgtctgggtgctctatagctggtttatttagcaagcttcatggtcctgagaagtataggtgggtatattctcattaagatagtgatatggtttgggtctgtgtccctgcccaaacctcatgttgaattgtaattcccaatgttggaggtggggcctggtgggaggtgactggatcatgtgggcagatttcctgctttggcactgttcttgcaatagagttctcacgagatctgattgtgtgaaagcatgtggcacctccccctatcaccactgctctgaccatgtaagacatgcctgcttcccctttgccttctgccatgattataagtttcctgaagcctccccagtcatgcttcctatacagcttgcagaaccgtgagcatatgaaacctcatttctttataaattatccaacttcaggtatttctttatagcagtatgaaaactgactaatacagatatattactatatttcattgaatcccatgtcaattgtaagatataccattgtcattatgtattactgagaaagaaaatactgttaattataattgtaagagacacctctatttcagagatgttaaaatgtgaaaaaaatatgcatcatagaattttaataaatatagtagttgagcttgctgtatgcagatcgtaaggagaaaagtctaggaaacagattcttggggtctttatattaatatacactccctgcccaacacacacacacacacacacaaacacacacacacacacacacacacacacacttcttcttagtattgcctttaaggttgagataattcaacacagacaatttatttaatagattatcagagcacccattatgtattgagccctgtaccaggcactgagatactaaatgaaacaaaacaaaacacaaagcagaatcatcccttaggatgctgacagttttataggagggatagatatgtgagccagacttgagaatatattctgtgaagctgctatacagagggatggaagtgggctttaatttttttctgagacagagtgtctcaccattcagaaaaggctgggtctgttagtggatgacatttcccacccctttaatctacacccttcctggctttctcaaaaagtgcattgggaggaaatcagaatcaatactgtgaaaagaagcttattttctccatcaattaccagtgcaggagagcacattttcactttttctttttaaaggcaaaacaccgatttggataaagttgaatagcttccagctttggcctagcttctccactctgtgtttgtgaaagtgtcccttattctgttataacccaagtgtcaataacaggtacacttgctgatgaggaattgcatcatggtcagcagtaggttttattttatatcagttaatttcgaggttttcatcacttatttttcaccatttccttgggagagactaatgtcattcctggttttttaataaacaattgccacagaggaaactttgatcgatctacagttggactttcacaggacaggctgaaattaaatgcccaacaactaaaatgacttatcaccaaaaaagtactagaaaaaaaacttgggggaaatgttttgtttttataatcacaacagtagagaataacataaagcacagaagccgtacaagaacaatgcaactacttaacaataaatacacaagccagaaaacaccgtatacaaatcaaaagacaaaataatcacaggttgaaattgtttgaaacatagggttcagtttcttgaaaaataaggagtttttacaaattaagaaaaaaaatgtgcagtcttgtgaacaagacagttcacagagaaggaaatactgaagccttttttttttttttttttttgagacggagtcttgctgtgtcgcccaggctggcgtgcagtggcgccatctcgggtcactgcaagctccccctcccgggttcacgccattctcctgcctctgcctcccgagtagctgggaatacaggtccccgccaccacgcctggctaattttttttgtattttttagtagagatggggtttcaccgtgttagccaggatggtctctatctcctgaccttgtgatccgcccgcctcggcctcccgaagtgctgggattacaggtgtgagccaccgcgcccagcctgaagactttttaaacatgcagatttttaacctctcaggctggcatggagacctataattccacatctaggaagatatcttacacatgttcacatgcattcagaatgatgcaagtacacatatattcattgtagtgtcatgtgtaatagcaaaagagtgaggagatctacaaatgcccttcactagaggactggttatctaagttattgaacatctgtacaatggaacagcatgcacttgtcagaagaagtgagtcagctcttcatgtgctaacctcaagaagggttaaacgaaaaaaggccaggtgaagaatagtatgtaggatggggcacagtggctcacacctataatctcagcactttgggaggccaaggtgggcagatcacttgaagttaggagtttgagaacagcctggccaacatggtgaaaccccatctctactaaaactacaaaaatcatctgggcctggtggtgcatgcctgtaatcccagctagtcaggaggctaaggcacgaaaatcaattgaatacaggatatggaggctgcagtgagccgagattgcaccactgcactccagcctgggagacacgaaaaaaacaaaaccaaaaaaacaacagtatgtacattgtgccaccatattgcaaaaatatatacatatatatacacacacacacagtatatacatagatgttaaaaattgttttaaaaaataaggggggtggagaacatatatacttatttattggtataagtatagactgtctctatctctggaagagtatattgtgacttggtaacagtagttaccaccacggagggaaactgagttgccgagacttggaagtcagaggttaaggtcaaaggttaacttagacttgtagaccatatgcattgtaattctaatggcatgaatctaattaatggacttattatgcaatgctaatttaatcagatttgatgagttcaaaaagcccgagtcataaagatgaacttaagccttcttacttcaaggtcttgagtttcctacgaaattactttccatcctccacagtgtcttatggcaagctttaaaaaggtttgcgaaactttttctcatggatagaattatcgaaaggcttttttgtgggaaagattttccaatagaagtttagggaaacctaaggaatttccaatggagcatgatctcctcatgttccgatggtgctgagctcttaaaagtcttggcaatattttcaaacgtgagtgggctccagctctgaaccaagagaacccacttattcactgtcctcacttcctctttttgagaaagctaatcagtgagtcagctcagggctgcaacaccactaccgttgatgtcagcagcctggacagcctgcagacacccgtgccggtagcggggcggggctgcccccccttttccctccctccggagccagctggttcttaccagctttggcagctttgtgcagcactatttgttgtggcttttctcctgtacatacaggaaaggcacagctctcttgcttagggcaaggattggctattgacactttgacttaaatgggggtggatttatagactttggggctcaattttgaaattaactcttagaaatgatgagaattctaagacgaggtatatacagaaaattatagccaactaccttgatttgagtttggggtatttaagcgagaaacccaccgtgaccagctaacctagtctaacttcataggccttaagtaaggttgcagttgaaacaaaaccttttcattattctgtgcttgaacagatctggggtgagtgggagtgttttttaaaataattccccagtggttttggcatttttttggccaggttaatcctgagattcccctgatggtgggtgagtttgttctgcaggctctgcattggctcccagcttaaggttcactcacctatgccatctctgtggtctggcttgggggttcccaaggaagctgagcagaacatcttggtgttgtgctcctgttctttcttccatcccatgacatccagtgatcccagggagctctagacagcagatggccctcgctgtccacttggcaattgacaatttagatttaagtgttggtgctgttccctacttatgcaatggaagcacctccttgcttcatgtactaaagtctgggctgtgcaggagaagaagaaagaaggaaagaaaacaagaggttttaactcaacaattagaagcccaggaaaagtttggggaatttttctcttaaagttacttgactcttggcccttctctttaattttttaaaataatgttttaagagaagacttacgaagcaaagaaaatttggaagcacattacaacaaataataaatctaccatctagattcaattgttattcacattttggcatatttgctttatctatgtatgtatacgtttccagtccatattcccatttcgaagactttctctaaatttcttataactgataatccttctttcaagcatttagaaatcagcatttttccatttgcctcttaagatttttgtttgcaaaaaaaaaattgggtacatttgggttctgcttgccaagaccccttactctggattgaattgaacaagaattcacactcagaagaataattttaaaatcattgtctctcatcatctgaaactttttttttagggtgatgtatttgtttttattttttaagggagaaatcattatatacaagtattttacagtgtccgaacttaggaattgaatagattcagataaattgttttgtgatgaggctggtaacctcattatatgaacccttatttatatctgaaatcctggaaccacatagatttgaataagaaagcatttcttattatctgaattcctcttctctaaagaccacatagattcagatatcaagaaatacttttctggcaaagaaaatatgcctttttttcctcccagagcccatcttatatgcctgtataggcctatagaaggtcttgaaatctaatttgattttgattatgtgggcagctgggagagcaggggaaacaggcttgagataatatcataattcttaaatagttgtaattttatatttattcgcgactagaattcctttgagataaacctttagtagaaattgaatttgtttgtttgtttttttaaccagccacttgtctgttgggatctgaaatattttcaatagaaaacaaagttattggctacagttgaggtatctggtattcacagaatctctcatatttatcttagcgcagtcatccagctggagtgtaagtctgccattgagtcccaggtacttgcagatctcaacctctacccacttcactctagcggaggggctcgggcaatgccctgtggtcatgtgatcgcttgtaatcagtttacagggtttgtcaattttctctaaatgctgtggggtccagacagggaagtgacatggcagcaaagagggtaactttgaaactagacagacctggtcttgaatcctggttctatggcttggggcaagttattacctcttagagcctcagtttcctcatctgtaaaatggggctgatacaacttccttagcagcaaacgaatcacagatattttctgctgaatcacctagcacagtattggcaatggcttatttcttcaggtctctttttgttacctcatatggaaaagcagtaagtttcagttagatttagcaaatgggcttttaaaaaccattattaaagtgagagattttcacaaatgtaacatagaactcttccttctttctaagtgttgaatgaggtctggagggaaaattaaatcaaaacagcgactttactgtaaggagctttctgctggggactatcaggcatatctagttatattagggaaaaggggcctggtggtattgaactgggtagtgtcaggagccaaggggttaaatggaaccattttagcaggctggcaaagagcatccaggctgggcaattaatgcttcatttcagggggtcgctgatgcatcaaagtcattaattagttttatgaaaacagattgtgcaaccacagggagattgtaattgggtagtaattgaaaataactttgtggtaaactttcgttgagcaggtagttcaggtgggggtaacttggaaggggaaagagaattggagtgggggattagggcatgaggagaatgaaatagcaacagtaagacaagcaataaataagacataatttgaatgaaaggaacacagaagtgacctggtctaacctatttaggttagaagtgagaccacaggtctgatgagggaagtggttttcctagtgccacacagctagttagtgttatgtcttctctcttttcttgcaatgctttttccaggattttcatgactttgatttttaggagctgactatggggaacatgaagtacatgccacacagatggcagttgaggctggagttctcgcctattcctgctctcagagtctacccaagaatgctgccagatcttgctgcctcgaaatcttatttcatttatctaccacccttgtcatgaataaaatttggaaggattttcctttaccatccatggctctgccatccccggggctaggggaatactgcaacctccaccagtgtgtcatctcaggaaaggtcagtcaacagggaagtgatttttcagtttgatattagaagtggagaattatttttgggcttcagtttcctttttttttttttttttttttttttgagatggagtcttgctctgttgcccaggctggagtgcaggggcgtgatctcgcctcactgcaacctccgcctccccagttcaagcaatcctcctgcctcagcctcctgagcagctgggattacaggcatgtgccaccatgcccggctaatttttgtagttttagtagagacagggtttcgctatgttgaccaggctggtcttgaactcctgacctacagtgatctgcccatttggcctcccaaagtgttgggattacaggtgtaagccactgcgcccagcctcagtttcccattttgatttggttaagcatccagagtgggtacttcagttttttagaagtctgcttggtgcaggaatgtagggttggcaaggacacagctggaaatggggaaaggcaatgatgacagtcatggttcattgtggtacaatccagatacaagttaaatcattattctcataaacactgctaccaaactcagtagcccagagatgttcagattcccaaagcagtagtctgtttacctaatccatttggatggttccttgtactcagtggtagaggtgctcggaaaggaaaattgtcagcagcagagctttaggtgtgactcagccttgagtgagttgaaccatttatctttcttcccttatcagtttggactaataagtatctggaaggactaagtgtgtttgcatggaaactaatcagaaggacatttggaacttgtttggctgaaagaaatgccatgctcttgaagttcacaaaatagaattgttctcttttgggctgctttgggagccccctaccattttggtctatttactgtccccacctcatttctcacatgagtcttccaagttaggattatgtcatggcagtaggcaaaaagaactgtagttttcaagtttctccaaaggagcttcaaataagtgacagatacattgcctttacaggccacgttttcttaatatctgccttattgaaataagctggggcatgtatgaatgccgtgtccacaaacatttcacaaaagtatagagaggagctcagccacattgataatcttcctgttaccctgtttcttggctacctatataaataagagctgctacagccacaacattttcaaggtagcagaaggaaaatatacttatcggtagtgactgcttttaaaaacaacatttattgattttctagctgtcaaagttaatatatctttttttctttctttttttttgagacagagtctcactccgtcgtccaggctggagggcagtggcacgatcttggctcactgcaacctccacctccctggttcaagcgattctcctgcctcagactcccaagtagttgggattacaggcgcctgccaccacgcctggctcatttttgtatttttagtggagacagggtttcaccatgttgcccaggcttgtcttgaactcctgacctcaagtgacccacccaccttggcctcccaaagtgctagtattataggtcaactggttatggtcaactgaaatgggaggatgtatgtataaaatattaaatggaacaaaaaaaaataggtgtgagtcaccgtgcccagcctaatatatctttacagagaatttggaaaactcaaagaaccttaggaaataaattattttattttataagtatcttggtaagtttatgctcaaagtttttataagaggatcctcttctctggaaatatggctttcttgtttagagtatttgttttctctttagtatctaaatcttattgtaggtgttcttcattggctataaactcagaatactgaaccataaactttcagaattaataaaacaaggaattaatttatttcacatattccgatgactcactgttctgattagaaagcagaagtaacacaatgcctagtacggtagcagtactgcaaaccggctttgatggatattgtatatattatggtaaagcacggaaagaaatttctatgagcatttttttttcttttgggaaaaagtgaaaacaactttagatgaagtcaaaatgcaaccagctacggttgcacaaagtgagagatacttatagttagtaactgagtagattttctggaaagatgatttttaaatggtctctggctttagtgatgcttgttagctctgctgtgatgctaatagcatttgtaggggcattttcatattcacctgactcattgttaattacaggagagcatcagttcagcattctgtctttccaattatgtcggaaatcatgtgcttaagttttactaataggaccttttggtgaaatcggggggggaaattaaacatttcaagttttcaaatgaatttaggaaacaggtgagtggactttttgctcattggcatgtgatttgtgggtggaaatttccttttaagcaagaacagtgtactatattgactgaccatgtcttccaaggtattgtccctgagaaccaggatgtagacaagtgttcttagtctaactgagtgaattaaaaaagtgtgttggcgtgaatggccatgtgcattttcaaggaggaggggcatgcgccagggcctatggaattaacattttacaagcatatacgtaacatttgtctgtaggtcagaaagggactgctaggtgtgcatgtttcccaagtctgaaacttgccctggaagcagcagcagggtgtgggtggtggttcagaggaaaaacgctgttggaacattagacatgtgcagtaatcagttatcttcacaatctgcaatcagttgcaagaatttctcaggccttaaaatttgtaaaagaagcagttgtgtttgctttgtgccttatataactatcccacgtaatactttgaaatatcaatgtcttcgttgaaaagcttgaaaacattttacttgaagtgtgtgagtgaagggatgaggattctaaggagtggtgattaacagcttggggagagtgcccatcattccctgaaccctgctctgtgtgatctggccagctggctcccaggtttttttatccatgccggaagagccaataaaaagataaagtcaattactaggagaggccacaagtgcctgccagagttctgatgtattttctcaaatgaaagggccaaatagagatgtcaagcaggcctgagttgagcactggctttctgccagtagctgtgtgccctctttgggccgcagtcactttactggtaaaatgaagtcacatcacctatcacttccccttctctccactgcacacccccagtacaagccatagtcatactgtatgtagccactgtaggagcgtcctaactgctctccctactttgaatcttgcctccctaaaatccattctctacccaccagccagagtggtggtgaagctcaccatctttatctgaaaccatcttgtgtgtttgttattgtctctctgacctccccactccagaatgcaatcttcacagtctctgttctatccttttggtcattactctcctcctagccactgacacctctcattttctcctgttctcattcttaattttagcagtttttttcctgagctagtttgaaatgggagtcagaaaacctggggtctagttttagttctgtgacttccttgttggcccttagttaagaaagtcacttcacttctccaggccccagtttccttccctgtgaagctgagtgtaagagtcagcaagcactgcagtaacaaaggaccgcagactgcatggcttaaacaacagaaattggtcttctcacaattctggagcctcagaaggccaagaccaaggtgtcttctgaggtctctctcttggcttgcagatggctgccttatcaccatgtcttcactgtgtcttccctctgtgtgcgtctgtgtcctcatcgcttctttttattaaagacaccagttatatcggagtgtagccaaccctaaagacctcattttactgtaattacctctttaaaggccctctctcacagtagtcgcattctgaagtactgggggtcagggcttcaacatggaggtggcataattcattcagctcataatactaaattatatctaagactcctttcagctctacaaaattatattttaaatcggggatctttctccttacacccatgttcccttctactcccctgagataatagcttggttcatatgcctccccgtttttagtactcatgcatatcctcactgtatttttgaagggtttaaaagtctgtgtatgtgtctagcaatcatataaataagttaaggtcaactgaagtgggaggatgtatatataaaatgttaaatggaacaaaaaaaatagcctctgaggagggattttaattttactgtttttttttctatatataataaaaaaaaattttccctcctacagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaaggtacgggcatcgcagcagacctcacacacgcacttaaaccccccaaagagcccctgggattcgtccctccccgtccacagtccagttgtagctgagagttgagtcatctgaattacctgcccaggaagaccagtccaaaacttcaagatacgctggcccgagagtaacctcgccattggctggcgaagacacgcctccaaaatctttgcagctcgcactgcccggtggagagctatcggccaccctttatcctcatgatgctatcaaatgtgtgtttcggggaaggcctgataaaatgtagtctggcaagatttttgaaaattatttaccaagcttgctgtatccaaagatttaaagttgaacttatcttgagagtcagaagtacaggttttaggccgtgcgcagcagctcacgcctgtaatccgagcactttggaaggccgaggtgggcggatcacttgaagccaggagttagagatgagcctggccaacatggtgaaaccccatctctactaaaaaaaaagaaaaattagcccgctgtagttccagctactcagaggctgaggcaaaagaatcacttgaacctgagacgcggaggctgcagtgagctgagattgtgccactgtactccagactgggtgacaagagcaaaactttgtcccaaaaaaaagaaaactacaggttttagtgacttaaaaataccctaaaattcactttgttaaactacattgcaaataccaatattttaaacattatggattggtagttttggcaaagaatttgcaacttttaatttttaatatcggggtagggaattagcatacactatttatgacagtttttaaagaaattttctagttttgggtaattccagttatattttagtgaaagggttatatttgatattttacgtatttataaaatgttatatttacatatttataatttgtgtactttatatatttatattaatctattttacatttacataaaatatttatattttagtttatattttatgttatataatatattttagaaaaagtgctttataatagtaataaaagttatagttcctcatcccaatgtaaggtatgacctgagaagaaatcatattttcttatttatgtgcttttactctctcagcagtttagttctaaaatattacaatgtaatcagaaagtcacataagtagactacattgtcttggaatttttgatcatttggaaaggggtgggcctatgtatatcttagtttagtaaacacatttcagatagggaaagcagtaaaggttttttagttttttgtttttgtttctttggtttctttaagtatctcaccattcaccttctgaattctaaaataatttagaagttacttaagtctaggcaaatgtcacattaatgataactcagcaagccattcaagcaagaccttgtctgatctctaccaggcaaatcttgtttgctatcttacacgtgcaacacaagtaaaaactcttgtgttgtttcgaatgtgccagaggatcactcactctctcactgtaatggaggatggagaataataggctgggggggacatagatgtctctctctctaggaccctgctctccttcctccaggccttgccagtacagtcaccttacagctgtctttgcttccctctcttctctgcagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttacttaagtagtccgagtatatttaatcgttgaatttcttgctttgtacatgtcctctagttgtgactctttgattagtcttttgcaaaagtatgtgtgctctaaaaacctcagctattctaatctgtaaatcgtggaaattagcaaagatttcaggcagggcatccacttccattttctcactgaaagaggaacttaaaattgctaaggtctggttgttggaattctgtagagccacagttcccaagcaaagggagacatgcaatgaatatgatatgatatatgatatgctataatgtattctacaattctatagatttgtgtttggaaaggtacctggaggttcgtagggaaggactttagtgaaaactaccaagcacttcctagtcttttggattaagtctgagaattcagtttttgagattgtccttattataggaaatgggtagatacctcattgttcctgaataagttcagagggctctcatggtcttgaggcagggtgagatctcatgttgatagaatatattgtagcatatcatatatcatatcatattcattgcatgtttccctttgcttgggaaccgtggctctacagaattccaacaaccagaaccttagcaattttaagttcctctttcagtgagaaactggaagtggatgccctgcccgaacatttggacacccacgtcagcgacattaaagggtttttctggtttcatccacttccacatggttggtttctagagaactatcctggtatttaatt

SEQ ID NO: 14372 - DNA, 13090 bp, Human; identical to SEQ ID NO: 12450
  misc_feature (1)...(13090): n = A,T,C or G

SEQ ID NO: 14373 - DNA, 39088 bp, Human
tggaactaaaaaaatatataaataacatatatatatatttgggatcttaaacctgcatattaagatctactggtagatgttagttttatctgaaagtttccacataaattgtgagcaccaatgcccatctcaaccatttggttgccctcctcaaccagtttggttgatccaatgccagcgcccagctcccactgcaggcatcaccacacgaccctgatctggcagacgctgtgcacagggacgtctacgggggtgggaggatgggttccagggaaactgttctttcttaataaaaaggaactgatgtggttggagctgcccttgctcccctctttgcatcttcaacgtgggccagatgttcagaactgcagtgacattttgtgcccccaggatgccaagcaaggggcacaatccagccaaccaaggatgacagagacgagacagagaggggtcccagtggaaccaagaacagctgaatgaacaccagccaccacctcctagtgcactcctggtctatgaggaaataaacccccacgtgtaaattgctctagttgttctatttcttgcagctgaacacattctaatcgacataactgtcaggggaaaagaccttcagagaaatgtgcatgttgtactgttttgtgaaatgagattatgtatgattgcacaatagttgtgagcacattgaaagactggaagggcggctgggcgtgatggctcacgcctgtaatcccagcactttgggaggccgaggcgggcggatcacgaggtcaggaaatcgagaccatcctggctaacacggtgaaaccccgtctctactaaaaatacaaaaaattagccaagcgtcgtggcaggcgcctgtagtcccagctactcgggaggctgaggcaggagaatagcgtgaacctggaaggcggagcttgcagtgagccgagatcacgccactgcactccagcctgggcgacagagtgagactccatctcaaaaaaaaaaaaaaaaaaaaaaaaaaactggaagggcaataataggtaacaaagtactgagcacctactatactaggtacatctcattgcagccactctataagatggatgcttcacggttatgctcatttaagagtgagacaactgaggttccaaggggtttaataactttctcaaatcatgcaaccaacagatagctagcttgggactcacagccaggtctggctggccctagagaaagtgcttccaccaccatatgcaccccaccagtgcctactggctgcacagaccgccaccagccctagcagcagtgatttctggagagtgggatgggagaatgggctggtggtgaggaggtttgtctttatccacttctttagtgtttcctttttaacaagcaatttttgttacaaaagtggacatccagagatattgacaaaataacactggtgccaggaactgtgctaggaatataatagttttcttccggatctggatctctactgtggatatccactggtcatacatgcctactggaaataaaaagcattctttcctaacttattccaaaccctggctaaaggaattctggggttgccattatgttactatgtgacctacgtcccagataaggaacctgcgaatctgccacctccgccctcgggagagccaggccctgcagtcactatatgtgaagaatcctttggagcctggaataagagggttttatgcatcattttttaatcaactggatttctcacctcccacctgtgcctaaatggtggcttcttggtatcttgaaagggggtgctcagcaggagaaagcagctccatgtttctgggcagcccgtcctatttacagactgctgcggctccctggcagctgccacagtccccgaggccagagggagttccttgagggccccagcagttgtttgagtcatgtgttttgggcccttttccttagagatcctggcagggccagcacagatttcttatcggcttccacactgcggagctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtgagtcctggggagcaggcatggggcacagagcaccccaggcccaggcaggggtgtgggagctgcaggtgctttggcaagaaactgggtccaaagcttattggccctgtgtgccctagatggaagctgcatttcaagttcctatcatgtgtgctttgataaaggggcctttgacttgttttgagaaaggaacgaaaacatgctatgaagaaatacacatataatttttccagttattataatgataccaagtgcagtggcttgttgcattaaaatatgtattgtgttatcatgacttgtacttgcacagagagagtctcactggaacaaagaagtagaggggtgacgtgaaatatctctttatgccttttgcagacatgagtgttttattgtaataagctttgcaaatatgttaggagctggaaattatgtacgacataggaagcttggtagagccccttcctgcatctgctctctcatcatctaaaggagtgttttgctggctacgtgttttatttcttctctgtgactctttctttatcttcacctccacttggtgtgcaggaagccaggaggtgctagtcctgggaggggagcgcagaggtttcttccacagggttctctttggtgctttatcccagcacagatgaggccaggttcacattacactgctgatggtcacagcccagtgtccagtttaagtctgtaataaaaagaatccggtggccaggcacggtggctcctgtctgtaatcctggcactttgggaggccaaggtgggtggatcatgaggtcaagagatcaagaccatcctggccaacatgttgaaaccctgtctctactaaaaatacaaaaattagttgggtgtggtggcgggcgcctgtagtcccggctactcgggaggctgaggcaggagaatcgcttgaacctgggagatggaggttgcggtgagtcgagatcgtaccactgcactccagcctgggtgacaggacgagattccatctcaaaacatacaaacaaacaaacaaaaccccagctttctttgggcttcccttgtagtaattccaggggaggtcctctcaggagctgaaggaacacatattttggggatgaaagagactcaaaatgaggagctaacaaagtccaatcatttaaaatatttactctgagcaattaagtgcttttaacacaaaaagtgatagcattagattacaagatgtaattatcatttgatcaccacagactgtatttatttaggggtggtgacccagtagcaggacccaggttaacggtgcattatccttgcttttttcctgtgggtggatgcttcagctctgtttttacctcatttggcaataacagccacgctctgcatttaatcgccttccagaatgtgagggcaggcggtgccctgttctgctcctgtgggtgacagccctgctgagtgacggtagacagggactttgcctctccctgtgcggaccctgctatcctcaatgcggttgcctgagtccatctcagggtgattcatccacataaattgggctccccctctgtgcagggctcttggctaggcagtggctgccatggtaggggtcttgcttatctgctgcaaaactctgactttatggcggttgagcaaggagacaaagtggccctaggaactggataattgaggtgcttattaatttggcatttcctaccgtgtgataatgggcgtgatttactcttgctaggaccttagattccctttgtgaaatggagagtatagtagcatccctaactcttagggttgttgcagagttagcgagcgcatgtgatgacgatttcaactgtgccggccccgtaagacacgcacagtgcctgtcactaccgcggttccaagcccagaccagatttgcctgtgcctgagccgtcaatgaccactggcggcatttgaggagcctttcagccccccactgcactgtgggagccactttctgggctggccaaggctggagcccactccctcagctttcagggaggtgtggagggagaggtgcgagcgggaactggggctgcgtgcggcgcttgcgggccagctggagttccgggtgggcgtgggcttggcgggcccgcactcggagcagccagccagccctgctggcccccggcaatgggggacttagcacccgggccagtggctgcggagggtgtactgagtcccccagcagtgctggcccactggcgctgcgctcgatttctcgctgggccttaggtgccttcccgcggggcagggctcgggacctgcagcccgccatgcctgagcctcccatccactccatgggctcctgtgcggcccgagcctccccgacgagcgccaccccccgctccacagcgctcagtcccatcgaccacccaagggctgaggaatgcgagcgcacggcgcaggactggcaggcagctccacctgcagccccggtgcgggatccactaggtgaagccagctgggctcctgagtctggtggggacgtggagagtctttatatctagctcagggattgtaaatacaccaatcagcaccctgtgtttagctcaaggtttgtgagtgcaccaatcgacactctgtatctagctgctctggtggggccttggagaacctgtgtgtggaaactctgtatctaactaatctgatggggacgtggagaacctttgtatgtagctcagggattgtaaacgcaccaatcagcgccctgacaaaacaggccactcggctctaccaatcagcaggatgtgggtgggccagataagagaataaaagcaggctgcctaaaccagcatcggcaacccgtttgggtctctttccacactgtggaggctttgttctttcgctcttgctgctgctcactctttgggtccacgctgcttttatgatctgtaacactcaccgcgaagatctgcagcttcacttctgagcccagtgagaccacgagcccactgggaggaacgaacaactccagatgcgccaccttaaaagctgtaacactcaccgcgagggtccgcggcttcattcttgaagtcagtgagaccaagaacctaccaattccggacacaccaccaccacccaggcaggggaccgcaagcccctggctccttttggggagatctttctagcaagggctccgtgaatgcaatttaaaagttatgagagtctccttttccccttctctttcctcttcttatggtgggaacaagagaggctggagtgcccgcctggagcctctccttggctttctcatggccgtgggggatcattcctttagagactgttagttagctttagtgtcagtcagaacactgcaagatactgtcctacgggctagagagcccctttcacccatcatctcaggtgaagctattgccgggaactcacatctcctggtgagtttccattctttctaggaggaggggtgctgcccagtgcctggagagagggtgcagggggtcggctgaggggtggggttaggcggatgagggggcatttgcaaagcgcaggacagaggctgtttctcagctctgcccaccgcaggcctgggcctgctgttcattctccagtggcaagcgcattcagattccatatcgaaccaaggcctgtgtttgtggtcccctgaaactcagatgcagtcagcctagttttgttgctgctgttgcttgcttgcttttgtcttgaccaggaggcacagtctttggggtgaggctgctaggagtgttttccaagacagctgactgctcacgtcatggttcctcagacaccaaatgatgtgctgtgggtgggggttggtgttggggggtgaggtgggggtgctgttcagggaagagggtgggaaatgagtttgcccccagcttaaggtagatcagtggttctcaaccctggctacctgttagaaccacctgagatttccttcaacaaataaatagcattcacatcagtaggcaaaggaaattcctttcttgccatcctttcctcataactcagtgagcagacatggagcatgggctgtgtgtctgggcactgcagaaacagacagaaggatggatcctgccctctgcaagcaggtcatgcagcaggaagccagtccgtgagtgtggtgaacactgaggagggatgatggggtgtttctggtgtgtggggcccacttgagaggaccagggaggcgtcccagagaggaaaaggaggaatagcaggaagaaagccgggcagagagcactgctgtggtgggaacaccattagtgaaggcgagaaggaccagagccgcttgctgggtgctggcccagggacatctgcggctgttggaacgtgagagggtggcggggtggctgagccttgctgtagtggtgcagggtggacacatgaaggatacggcttccctcagaatggaaaaaaaaatcctgccattgtggaagctcacagacaataaacaggacctagatggtggtcagggcagaggagaaaatgcatcgagtaagatgttggggaccagggaatgctgctccaaacagacggccagagaaggcactactgagagatgatccttgagccaaagcttgactggggtggccgtcacatggctcttgaggaagagtgtcccaggtggggcagcaaggccactgggcagtcagtcacaaggcaggtgtgtgccttggaggtttcagaggctggggctgaccctgtgaggatgagagagacgggcagccatgccaacccgggcgcagagattccacggtggtgcctgacacccacttgcggggacttggattttgcctctgggtaagactgggggcactttaggaggacccctcctgctggtgtgttgagaaccccctgaaggggcgagggtggaagtggggagacctttgcatatgaatgctctaaaacccaaagcctctagatagaattattttgagggtctccctccatcgctcaggctgcagtgcagtggcgtgatcacagctcactgcaacctccacctccccaggcttagatgatcctttcatctcagcctccaaagtagctgggactacaggtgtgtgccaccacatccagctaatttttgtatttttttgtaaagacagggtctcactgtgttgcccagactggtcttgaactcctgggctcaagcgacctacacgcctcggcctcccacagtgctgggattacaggcacgaggccctggccctgactggcatagaattctcgtagtagcactctcttatactgcttgggatggcagtgaagaaaaaaatgaaataagtctgcccccacatttccttctcagttcaagtaacaccaagctaccacagggcaattttaattcattccagcagggcactgtgtgaggacaatccacaaagacttgaaattccagggcttggccgggcatggtggctcatgcctgtaatcccagcactttgggaggctgaggcgggtggatcaccaggtcaggagatcaagaccatcctggctaacatggtgaaaccccgtctctactaaaaatacagaaaaaaattagccgggcgtggtggcgggcgcctgtagtcccagctactccggaggctgaggcaggagaacggcgtgagcccaggaggcggagcttgcagtgagcagagttcgtgccactgcactccagcctgggcgacagagcaagactccgtttcaaaaaaaaaaggaaaaaagaaaaaacaaattccaggagctggaggccacagtcctttacttttggagtcctcagttatggcaatgggtctgatttgatgagtccccccatctgctccatctccccgtgctgagactgggtttgtgttttagtgagactgagtcctgggtcatctcattggaaggctaagaaaatatgacaacgactccaaggtgtaagggaggcaaggctgagaggtatcctgccaggcataatcgccttcttctgcacgtgtgacttggagactccagagacacagaacgagaggggactgcactgctggcgttttagggtcccaggctctttgctggagttaagaccccctagtgacttcctcattcagccttttgtcttctcaggtatggaatcgcaggaagcgttaacgtgacgggagatgaggtgaagaaactggatgtgctatccaattccctggtgatcaacatgctccaatcctcctatagtacctgcgtcctggtctcagaagagaataaggacgccatcatcaccgccaaggagaagcgggtgcgtcatggggctgcggtgcccgctcgccagtagatgatgatactgagccggaaataagctgccttacttttctttaattcccgggattctcctctatttcttaacatttgttttctggaaacaaaggattacatacttctctacttggaaatcttgtgctgtctagagaaagaagactccacagtaggacagtgattcattcaggaaattgttcagagtgatgcaggaaccgcctcagtgggcgcttgttcgtggctgttcacttaatcagtaacaagagccaaatttttgggggcttaaccttgtggagtccagggaagagctgtactgtacagcctctcaccgccccgccttctcattccacccccgcccccagccggcactttgcgaggggttacagtttcagcagagatttcttagtgcctgacaagctgttagactggtccagaaacaaaaccacaagcctcctgtgctcttacctcgtaggatggtgaagtcggtgaaggaaggcacggctggggagggtctgcattcactatgggttcacacacagcttattatacagagaggtttgccaatggccaaaagtttcaatcaatgttcagctgcaatatagtcaatagacaagaggccatttctttgtgattagctggaggaatggaaaagaatttaaagtaaagccaaatttatttaacctctgctctatgccaggtactgcaaaaggcacttttgccctcgtctcacataattttagctacatcacactattacttccaactttcagtttcagttgatatgactcttgtttctctctccagtctgatctaccattgtcttctcctattggcctaagccacatagccacataggtcttcatgtcagttcctttatttatttatttacttatttatttatttttttgagacggagtcttgctctactgcccggctggacaggctggagtgcaatggcgcaatctcagctcactgtaacctctgcctcccgggttcaagcaattctcccgcctcagcctcctgagtagctgggattacaggcatgcgccaccatgccccgctaatttttgtgtttttagtagagacggggtttcgccatgttggccaggctggtcttgaactctgacctcaggtgatccacccgcctcaggctcccaaagtgctgggattacaggcgtgagccaccatgcctggcccgtggcagctcttgaatactccaaacctgctgatctctctgtcgaaaattcttctttctaggatgggcgcggtggctcacgcctgcaatcccggtgctttgggaggctgaggtgggaggattgcttgagctcaggagtttgagaccagcctaggcaacataaagatacaaaagataaaaatttagctcggcatggtggtgtgcacctgtagtcccagctactcgggagtctgaggtgggagaattgcttgagctcaggagtttgagaccagcctaggcaacataaagatacaaaagataaaaatttagctcggcatggtggtgtgcacctgtagtcccagctacttgggagtctgaggtgggaggattgcttgagcccaggatctctaggctgcagcgagctctgaccacaccactgcacttcatcctgggcaacagagtgagactctgtcaaaacaaaacaaaaacaagaaaacaaacaattttgctttctaggtctctgtgtgtttcttcattccttaattctagtcaggtctgtcatcaaatgtgaccccccctcatggctctccagcccccagcctatgtgggttttcgttagggcacgtgccacagcctgcttgtatgtgtcctgacctgtgtgctctctgtctgttctcccactggaatgtcagtgccatgaaatccagccttgctgccgggatcgctgaccccccggaaacaaaccccagggccttgaacacttacttcccagcatatgctggaagctcaacatgtatctgctgaatgcatgcatgcatgaatgaatgggctaaattggattttttttttaaaaattggattattatagagatgttggggaatttccaagtttacaaattatctaacttttctactctggctgagcaaggaaaaaaaacagaaacaaagctcaaatgaagctaggccaatactcattggaaagtcagggaaaactaaatcaagtggagggagaaatgaccctcatttctcttgaagttgcattacccgtgtttaattggcctgggggttccggtcgccatcactaagggtctctcgtgaccttgcacacagggggctataaaaaggacctggggcttcccttggtggcttgagctgcctgtgacagcagagtgggtgggtgtgggggacgttggtctctcaagacacacccactttatcttctggtcttcgcatcagacaggtgagatggatacaaaacccagaggagtatttgtgtataaactggcaccctgccctccgtaagtcatggtgttttttgataaagatatgctgtggttctcaatctctttttgatgtggtgtactctgccacgcacagccctgacacagagcaattgtgctaatgggaagatgtgctgatcagttggtgctttcctctctgatttaggggaaatacgtggtctgctttgacccactggatggatcttccaatattgactgcctggcctccatcggaaccatctttgccatctatagaaaggtgagtagacaggctgacattttacacctccttcctgtggtggtctctggaaggttcctgggctgaaaaccgtgtgtttggagtcctaccctttgtcttcccactaacgagaaaagccactgtaggcaaaccaccaacttttctctgcctggggctcctcattagaagaactggattggcgattctttctctgcctactttctggcattcctgggagggtaacacagaaggacagctgagatcttgttttgaaagtctgggtgcaacacaaatgtcagacatggcattaggttccaggtggcattctgaatctctgacatcctctccccctcttgcctcatctctcctgtccccagccacagaaagttttctgctaacgctcattggattagattgaactaatctaacctggaaggtccacggtgatctccctatttgaaatctgaacccctgagtacacctgaaaagtctttgttgccatgtaatgctgggtattcacagatcctggggactggcatatcttttgggccattctgcctaccctgaaatcctagcaacagagagctgggtgggtttgtgacatccagcaggactagaaacttcacaattcagaaaacttgtccttcattctatataaagtgtacaacggcaataaaatccatagcaacctcgccagctgcggtggctcacgcctgtaatcccagaactttgggaggctgaggcgggcggatcacttgaggccttgaggctaggtggtcgagaccagtctgggaaacatggtgaaaccccgtctctactaaaaatacaaaaattagccagggtgatggtgcacgcctgtaattccagctactcaggaggctgaggcaagagaattgcttgaacccaggaagtgcaggttgcagtgagctgagatcatgccactgcactccagcctgggtgacagagcaagactctctcaaacaaacaatccatagcaaccaaagagaaaaataagcagagtgccagttacattgtatttgagagtcttctatgtattaggaagttgattaaaccgtgctcttacagagtcttgagatagggaatctatggcagaaatatgagtatttaaggcctgtatagtttgggttatattgtgagaataatctggtagatatctaattctcagccttaattcatgcacaagtgttgccttgggttgtagttaggatatctaaagccatatgatttaaagacattgtgggattaagacatagtagcagtttgcttttctgtgtcttgtggggctgagggtatgttttgggcattattcaggaagtatgtacagcacttagttttacttatacttcatggtccccactgtcaattatatttggggttcctgtggggcttgataacaggttggcaaaatatacatatttaacaggctgggcatggtggctcatgcctgtaatcccagcattttgggaggctgaggtgggtggatcacctgaggtcaggagtttgagaccagcctggccaacatggtgaaactccatctctactaaaaataccaaaaattagctgggcatagtggcgggcgcctataatccctgctactcaggaggctgagacaggagaattgcttgaacccgggggcagaggttgcagtgagctgagattgcaccattgcactccagcctgggcaacaagagtgaaactgtgtctcaaaaaaaaaaaaaaaaaaaaagggggctgggaagggtggctcatgcctgtaatcccagcaatttgggaggccgaggcgggcgaatcacgaggtcaggagatcgagaccatcctggctaacatggtgaaaccctgcctctactaaaaatacaaaaaaattagccgggcgtggtggtgggtgcctgtagtcccagctacttgggaggctgaggcaggagaatggcgtgaacccaggaggcagagcttgtagtgagccaagatcgcgccactgcactctagcctgggtgacagagcgagactccgtctcaaaaaaaaaaaaaaaaaattagccaagagtggtggcatgtgactgtggtcccagctactcggctgagacatgagaattgcttgaacctggaggtggaagttatagtgagttgagattgcactgctgcactccagcctgggcaacagagcaagactccctctcaaaacaaacaaactatacacacacacacacacacacacacacacgcacacacacacatatttaacagattataggaggagctatgaatatttatgaagatggtcctgacatatgtgtattgaataaatatgcatgtatgacccatgtttattttggggtggaatgtattccatttaggtcctgtatatcaaaagatctttctaggacataaaggcacacagtgtgtgctttctgtaaactggccagacctagcccatggttggtggtcttttatcaggagagctactgaaatttagtcttttgtctaattaaagctgtagtcttggctggtggaacaagagcctgggggtgagttagtcagctgatcttaaggccagcgcttgtttggctgctagagaaaaagaaaaacctatggcagttaggacatggtttcctcttcaaaataggagtgagtgactaacccttgcctggcgtggccttaggtcccgtttctaattgggtattttattgtgacaaacagcctattttgtcaatcttagggttttcagttgtgcctaattccaaaaagtgggggaaggtatagggaggcctgtctgatcccgcttcctgccatggcctgaacttgtttttcagtttatctggggatttccttcggccaagaggcaggtccattcagtctgttgagaggcttaggattttattttagtttatattctcccttttttgtcaaggtattccaggggcagtattgatggccaagcttttattttgtcccatgtggatgctggggtggtatggttaccttcccagggtccatgatgttcctcgatgggacccctatggcccagggacttagagtcaaaacagtggaagccagttaaatgttccaggccagatgggaatggaggtggccaggcattcattaaccttaaaaccccttttaagcaatgtaaaagccaaaaacccaaagccaaaaggcaagcttccaaaattgacttatctacaaatctatacatcgagctactgtgagcttggctagtagcacttagctgcacaaaacacaagccttttgttcagctgttgaagcctctctgtgtccgtcctggatttggaggctctgaattaatttgatcccataagactggcccttactatgtcagacgctcacttcttccactatagtctttaggcctgggggattgaatagtttcaattctggaggtaaaacaaaatacaaagaattagtaatgttttaaagtatcataagcccagcctagttctgagaatgacaggaaaggaggcttataggtagttaagcattttaattatttggtattaaggcatagaataaatcatattactttagacagaggcaaaattaataaattaatcttactggttttgactacaaggctgtccttgtgtctcattaaagcaggtgactttgattgtcacctttgcctggatccagagacaaggctttggttagcttgagtttggtatcagatactggcaggagccaatgccttctttagatgaaatatgtgcacccaggagtcaaagccctgtaacttaactgcacaaggatttgttaatagtacctgataagggccttttttagggactagaggtagtgatactagagactttgacctgtctggaacctgtaaaatgattttaaaacctagtggtgattaatttttatagctttggtaaaccccagcagaaagtcagaaacttaatttaggattcaattttgaaaaagttaaagatgttaaaaggctcaaaacaattgattaaaacagaactgtaggtcattgttaaacaatagttgctcatttaaccagagtgataattgaaagattgaaaaggcaatccaggctgggcatggtggctcacacctgtaatcccatcactttgggaggctgaggcaggtggatcacttgaggccaggagttcaagaccagcctggccaacatggctaaacactgtctctgctaaaaatacaaaaattagctgggcgtgttggaccagccacttgagaggctgaggcatgagaatcacttgaacctaggaggcggtgattgcagtgagctgagattgtgccactgtactgcagcctgagcaacagagcaagattctgtctcaaacaaacaaacaaataaaaggcaatacagaacgttatatggttgtacaaactttaacccttttagatctcaacttttctaagcaattaaaacctaataaagacaacataggaattattttgataaaatgtaaaatgttgtttcttaagtgaattaccagacagggaaagaaaaacctgcagtgtagctgcttctctttaggggaagcctatttggataacctggaagtcaaactgtgagtgtatcagggaaatagataattctcagtaactgcatgagaagctttctaatcatattgacaaatttagacatatcaaggaaagtacagaatcaagtaataatgtaggaaaacattgcttttctagacctttaagataaaatgttttagtgccaggccataataataaaattggaggaaaaagatcacaagagttgaggaaaaagctgaatgagagagttatcctctcaggccttctcaaggggagaaaaagctgaaagcagcaagacacagcaaagccaaacttctgagatatgattctgagaagtttttaagagaaagaggttataaaagtaaaatttcttgttattaggagcaaataaataccttaagacagacaaccttgctttaaacatagggggctattataaagaatccccttttaattataggtaacttaatcacatgcaaaattcttttataaattctccacaaactttaatacaatttatacaaaccatttatgacatgcttaaactttttgacttgtcctgaattttgtttctttagatatcagtcattatttttaggacaagaatttaccatacaacttttttttttttttttttttttttgagacagagtctcactctgtcgcccaggctggagtgcggtggcataatctcggctcactgcaagctccgcctactgggttcacaccattctcctgcctcagcctcctgagtagctgggactacaggcgcccggcaccatgcccggctaattttgtgtatttttagtagagacggggtttcaccgtgttagccaggatggtctccatctcctgacctcgttatctgcccgccttggcctcccaaaatgctgggattacaggcataagccaccgtgcctggccaagttttttttttaatatataaaattattctctcttttaaaataacctttttttttttttttttttttttttttttttttttgacagagtctctctctgttgcccaggctggagtgcagtggtgcaagctccgctcactgcaagctccgccttccgggttcacgccattctcctgcctcagcctcctgagtagctgggactacaggtgcccgccaccacacccagctaattttttgtatttttagtagagactgggtttcaccgtgttagccaggatggtctcgatctcctgaccttgtgatccgcctgcctcagccttccaaagtgctgggattacaggcctgagccaccacgtccagcctataaaattatttttacaatacgaatacaattcatagaattatatagtcattagaatttttatttctactaactttaaattttagtggaaacttagtaagcaagaagtcctgaacggtttgtcagatgttagcattttatagatgaagtcatttcacaattttagaaccatgttttcccatattttattgtaaattagtcccataatttattataatttttaaaaaattagaagtaaaccagacatccaataagcatttattatttaatttaaaataattttaagattttaaattacagaaaaaattcacttaaaaaacatatttcatttatgtgtatttaattttttaatctttaagtttatctagattctttctgaaaacagatattatacaaagttagtcattatttaaagttatttccctgttaaccattttaaaagtccgaacattaggtgaacacctaagtaagaacctcaaagttaaatccatggtcattttgccaatagctcagaggattcagttgctttcattgaactaacaatcctaacttagtcttatttgtcaaaaaaattacacaaagattactctgtgtttggctgggttataatcttacaatctttgcgccaaaccctgacactttaaacatttagcagagacaaatacaaaatttatttgcttagacacaaatgtatgctgatgattctgaaggcatttttgtttttattttactaataatttttgaagccagttttatttatcaaagattcatgcgaacttggaaagcatttgaacttaatttatgtgtactcacttacttataaagccaatttggtagcatgctagacacgacagaacataactataacatgtacattacataaacatatctaaacatgtatacatccatacacaaacaaaggtctaagagcttttatctgagaactctaatcatgagatagcatcacaaactcactgacctataaaagctggcttcaagttgtttttctgacaaaattggaagctgtccacgtggctaactttgtttgccctgataggtaatccaaggaaagctggcagccaaaatttggggtaaagcagtctctatggcagtttgggtttttttctttttaaatcttttcccctttttgctgttcagtttcaaatgagttttcaatgtttatattcaatttagaccataaataatgagtcttgtctcgcgccagcagtttaataacagcagatttaaagcaggcagaaaagagaggaaggtagagagctaaagaagattctacttaactccacagtgtaggttaaccatttgaactctgaatttttcttgttgtaatttgcccatcagtttaaaatgtgcacaaaaatgggccagaatatgtaaccagtcccagagaagatgacaaaatcagaggccatgatgttggaaactgtttttctccttcaaggctgaacccctggattggacaggaaatgagaaaaagaaaagaaagagatgtagaggacaaaggtcaagttttacaggaaggaagaggaaagagaaaggaaggaggggaggcttgtgagcctttcagccactgcaaggcttggggtcagtaccctcaccacccaggtgtatctcctgtcagggagagcctcagtgccccagacctacatggtgtgggatgaacccttcccacctttgcaagtcaccagtcaaggtgaaatgtttctagccagagggagctgtgggtgcttttggccaagaggaataaggctgtgggtgccccaagattatcaggaggatgacttggaagaagtggggggagggagggctgagtagagtcccaaatccctcacctcagtttccaatgcccccccaaccccagccctggaacagcctgaacccagcaaggccccaagggtgccacaaatacaaacaaatacaaatgcataaaatgctcaaatggtgtcactagtggccaagtctaaatagagcagagtcccagtgacatcccaaaagaggcagatggtggtcaaatgcactccgactaactcaccaagttccaaagtttcaaagttccaaaattccaaagtttgtcacttctctaaaagtcactttcagtgcaccagtgaaatattggaggtagcaggcactgcagcaggaagagaaagagaggatccccaagacaaaagcatctaggcagctgcaggagactccctagcattccagccaaggggtcaggtagccacaagcaactggagcctacaggcagccccacaggccctgtccaatagaaaccagaccatgggcttgggcccccagagcacactgtatgggccactaaaattgtaactgaatgcaggtccacatgctcactgcctgcagagtccagttaacaagagtgaggcctggtagatagaaagtgactttattaaccacaactagtaaaggggaagtggccagattcccatcaaagcaaccactttgactatttcgggggaagggaggggtttaaaagaggaaaacttgattaaggagggcatgcaagagaattgtgctgagtacagtatctctgggtcttgtttttatgattatctttggtgccagtccacctggacctcaggctgacatcatctcaacagtggccgagttgttaattagctgcatggaagtaatctctggaattttgcagctaggtctccatgcttggtctgtccgtctcaagattacctcctggaacttctaagaaggcacataatagatactagcatgcagttagctaaatgtgcagggagtatatatggtgagaaagggagctattttatagctaagagaaaagacttctgcagtttgcttcaaggttatatcttgaaacccaagagaagggaaaaatgttttaaaatatattatgaagttaagctgcccagttacgttaggaagatggaaattaaaaccacagtgagacaccattctcctcttccagagtggctaaatctaaaaagactaagcataccaagtgttggcaaagaaactggaattcttatacctcattggtgggactatcaaatagtataactactttggaaaacatttgataggacctactaatgctaaacagatatttacacactatggccaagcaatttcactcctgggacccacacagaagaaaggaattctgtgtctgcccaaagatggagaaattagtcatagtagccccaaaccagaaaaatccaaatgcatatcaacatgagaatggagaaataaattgtgatatagtcatacaacagaaaactacatagcaatgaaaaagaacaaactgctatgtataacaacataggtaaaattgcaaagaaataaacttgaaaatcataagccatacaaaagaacatatgcagtgtcatttcatttagatgatgttccaaaccagataaagttagatttggtgataaaggtgagaatagaggttacctttggcaggaggtgatagtgactggaagagactactaggcctggcttcactaggcttaaagtccactaggttgctggaaatgttatataaatggatctggatgttatgtaaaatattctataaatacacataagtgtatattatatatttgtaaaaatttatcaagatgtaccattaagatttgtatgctctgctatatgctttatacctcaacaaaaaggaaaaaagtccacatttcataatttctaccaccaaatacatggagctcttgcaattttcattaattttaccaaaaagtagtggtaggaagcaccacttatctgatgggctcagatatttattggtgtagaaaaaaataaaaagacgcactaaatcatttgcaaactactataaaatttactgagaaaggtgtcatggcaatgaagattgctgatataaactgggtttttgaaatctcaggaccgtgttagacaaatacaaaaactgaaccattcttttttttccatgcatagaaataaattacagatgagttgatgagtttggtagagaggtggggaataaaaccagaaagaaaagacaagaatatttgtgtcaccctgtcttgatgtaggagaaattcagtctaaacataaagacaagagaagaaaacatatggaatgtcatgaataattttaattttaaaactgcactgcaaaaacaggcaccataaataagaaggcaatgacaatcgaggaaaatatttgtaacatatacaagacattaatatcctttatatataaagagctattaaaataaacaagaagttgaatatcctgatagaaaaataagcaagacatgaaagagacaacttacaaaataaaaatggtcaaaataaacacataaaaggttttacctgactcataaaaaatagaagttaaaacaaaagagatgtcattttgtccacctgtcaaattgacaaagttgaaaagacaatgctatcttgtgtttaccaggctgaattaaaatgaactctcttattattagtggtaaaagtataaattgatgcactctttctggaagacaatttttcaatatgtatcaaaagatttttacccaattatttaattattgggaatttatcttgggaaaatgatcagagaattgtgtatttatgcagtagattgttaatctcaggttgccttgtttttcaaaaggataaaaagagaatattagaaacaactccacatgcatacatttgacaacttagatgaaacgaaccaatgtctcaaaaactacaatactctaactcacccaatataaaatagatactttgaatggctatctacagggctcaatactattaagaaactcatgcccaagaaaagaaatctccaggctcagatggtttactggaaaaacataacaaatattcacagattattcagtctcttccagaaaagataataggaaggaacacttcccaattcattttatgaaaccagtgttatcctgatacaaaaaccagacaaagattgttcaaaaaaataccacagaccaatattccttatcaataaatgcaaaaactcttaacaaaatattggcaaatagaattcaacaatacataaaataaattatacaccatggctgagtggggtttattctggtgatggaagactgatccagtattcagaatcagtcagtgtaatccaccatatcaacaggctaaagaagaaaaatcacacaatcgtatctattgatggagaaaaaacatttgaacaaattcaacactcattcattatttaaaaaataaacttgctgaggtaggaggattgcttgaggccaggagtttgagaccagcctgggcaacatagcaagacccccatctcaaaaaagacattagctggagagcggggtggtagtgcatacccgtagtcccagctactcaagaagttgagatgggaggatgacttaagcccaggagttggaggctgcagtgagccatgaccaagccactgcactccaccctgggcaacagagcaagaccctgtctctgaaaaaacagaaagtcttagaaaacaagaaatagaggaggagcgtcccttaactctatcaagtacatctacagctagcattacatttaatggtgaaagactgaatgcttatactctaagatcagtaacaaagcaaggatgtcctcactcgccactgttacccaacatatgtaatcctgaaagttgtagccagcacaataaggcaaggaagatgatgaaacacatacagattggaaagcaggtaataacactgttcttgcagacgacatgatggtctatgtagaaaatcccaaggaacctacaaacagaaaaccaaaacacttctagaactagtgagtttagcaaggtcacaggatacaagatcaagatacaaaatcaactagatttctatatattagcaataaactaattcgtaattataattacattttaaaatatgtgctatttacaatcacacaaaaaatggaacagtataaatccaaaaaatgtgtataggattcttatgctgaaaatcactgcatgtatgcatgtatatatgtgtgtgtgtaaactcatgtgtgtgttgtgtgtgtgtgtgaattaaatgcaatatctgtggactggattgtgctaggtgatgggtaaacagacaggaacaagacggagttggtacttgccaccaagttgctcacagtctagctgggaagtcagacactaagcccgtgaatgaaaatgtgttgggagcttcagagaagcagctctgagtgctcatggcgtcaagcgctggaagaccagaccatgaggtcagaacatggaggcaagaacattcgggtttacaaagcttctacgtacatcacaacaatgctgtactccaattctaggtttctggaggagagactcacattgggccagtttgaatcactaatctatgaatctatccttgaccccatcaaataagtgtgcgtgtgtgtgtgtcgtgggagacggggtaactcaatacaaatgtagcagctaagagtccccattttggataagggggtgaggaagaatcattttgcaccggttggatgtaccaagggccacagaaggaccagaaggagcaccaacatttaaggaatcagaggaagaggtgctgccgggaagagaggcaagtgagaaggagcatccacagagtcagagagaaaggcagaatcagggcttcctgctgctgggcgagttgtgcagccgctccagctgcagtaggttgttaatcttaggtggttttgctctcagagttctccctctgagccatggaggtgatggtgctatctgccccaaagggctgttgagtgtgcagagtgagacactgcacgctcagctcagtgatctgagttgtgagtatcgtggcttgggaacatggcttatgatgaagaggggctatggttttagcatctgggagtgcttttcttgtcaggctacagacacatgcgtttggaaaacaggaaggaagaagtccaagaatggcctttgccatggctcagctagaactgttggcaacatggccactcgtttcctctggatggatttgcagcagcttaaaattcaaagaaccgcgcttccttcagtgattcgaggagatctgaagcccaggcccctggcaaagtgttctctccagagacaacaataacacatggcatttatccctctcttccacagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggtaggtacagaatatggcatcatctgtgcctggggactccatgggcctctgtgccttaatgccagttctctgcgataatgtcctggttattcctaatacttgttttggggaccaggggtcctgagagcctagtttggggagccaaaaccatcatcagaaaccatgaagggcctctgtcccagtgagggcactcggggggaggagtgtcctgcagagccagttgcatcaactcaggccctctccttaaggagctcattttccaaaaatgcactcaatctctttggcttatgagaatgccatgatttaagaatcacaatgctgcaaatttccagcagaagcatgggttcgttagagcagcaccatccagtagaatgctccatgaatttcacttttaaatgctggatggcttgcccatcaattgtgaaatgctttgccaagtatactgaggtcttgtgaaaactcagataatatccaccaaagaacacgtcaaaacctcttgttcacttagaccaaaaggttaagtatttaagtttttgatttacagctgtttattgagcatctactgtgtcccaaagcaccactccagacagcggagatggagcattgatcaaacacacatgacagcccttgtggagttcacgtgttagtgcacatgtgtggagagaggggtttgcaaaatttcaaaatgacatggagttaacttacaaaacagagtttacagtatggaaacccagaaacttttcaaatagaatcttttcacctgtatgcccattagaccaagacccattgctgtgtcagtttgctaatgccccaatttccctttatgttcaaagaagctggcaaaccctgagaaattctatggcttgcaaatattaccctcagacaataaaacaccctttctaaagttgttgtagaataacagctaagagttagataattcttcgtaagtggtaggaatgtaaagtacctgtcctatgaaatttacatctattaatgcatttaaatgtcacagtggccctatgagatatgtcctacaattattcccattttcagatggggaaagtgaggcgtagagagagtgagtaacttgcgcaaggtcaagctagtgactggtgtcaggagtcatgctccagcagtctgtgctttaattactctaccacactaaatttccaacacaactgctcttgagtacaagcaaaatatctccatgaacattctgagcagttctaaaggtgatgggagatgctttgactcagggacccaattcaaagattcccaggcacagacagagcctctgttttctgccctcagtcatgaaagcagggcccagtctggacataggtgggcaccagagcttgtcaacatgacagaaggaagagatgaaccatagcatctttccggatctctatgtattagcctgaaacccctttggatcacatctccctactaaaaaggacatttgagcaaagacccagtgcacaaagcttagtgcctgtttgacatccagcggaggtagcttgtggcagttgtcacagatagaaatgccatggaaggcggccagtagcttatggaggcagcattccctggtgggtcaaactgagcctgtgaggtctgtgggattgcagggctggtgatttgattttgtcagaacacacatattgttcaggcacagagagaccacctcctgttaaccaactctccattgtgggtaaagctcaatgtcaaggcattcatttacaaatgggagctgttgtttcttgtgaccaggatctggtgtctgataatcggtaacagggtgtatgagagcccatattaaaaatcagccgttgttggtgaccacacaatcagaacaaaggaacacattttccaggttaataaaattgtggaaacaatattcccagggcctgagagtcccggccccagccccaggagtggatcaacgtaaggcgttttcacccgccctgatgcagaatgagcgcctctgttcaggtggtgagtgagtgccactgttcagatgacagttgtgcatctccatcctctttgctggaaagcaacagcaaaattgaccccggctcaattaagtgaaaggagttactgcattgatgggaaagctgaggaccctggctaggaacgggcaggactagaggaccaggaagcaggaagcacggcagtggtctcgcaacatggccggtctggcctggacaccaaccccagtgctgcgcctctcactcaggtttcaaatcctagggaggcgtatctcattttcaagctaaggtacatgcctgaccttggcctacaagaggcccagatatgagtcttcctagactggcatccaattcaaagcaagtcagggcacttttcagaagtagaaatcagcgctgggctgctccaaagcaacagacacccacagcaagttaaaggtcatgagtcaaagaccatcactcgtgcacctgtaataacccgaagttagaattaggaggcactgcagaggaaccatggggtgttgcataaggagggagttgagatgggcttataggacttggggttttgcttggtgattctaaagaggatttgaggaagagagggtcagtctggattggatattgtctggaagtgggtgcaattaatgactagttaccttaatcatttttatctaggaggcagagagattgaagtcactgatatagaagcagttgtcactcatgttaggcaggaaaggattgtttagttgtttttgttattgagtctccttggcactgacttgtttctgacagggacagtgtcacctcttgtagcaacacctctgctatgtggagtcattctgtggccttgcctctttatattccgggaatacctctgatgttccttgggaaccttctggcctagctgccaactgtgagctgtcattttggagtttttcactctcaaaatcttggacattcatcaaaatggatctggtttccaggctctggttttcctcctagtgacttagacagacatgagcatttaaggtggtatctgccacaagctgatcccatttttagtgactgctatcaccagaactagacataggggtatttgagagatgccctgcaggtactgaccacagtggctacacgggttgtggagagggactgggcacacttttattaatatgtctgaggattcctttagattttaccaactttttccttacgctgggtgaacacagtgtctgatgaaagcggcttcctcttttctccaggtaagagtgggataccagaaactgaatagtttctatgattgaatcactaacataaacaaaataactgtaccacacatttttttttttttttttgagatggagtcttgctctgtcatccaggctggagtgcagtggcgcgatctcggctcactgcaagctctgcctcccgggttcacaccattctcctgcctcagccccccgagtagctgggactacaggtgcccaccaccacgcctggccaattttttgtatatttagcaaagacggggtttcaccatgttagccaggatggtctcaatctcctgacctcgtgatccacccgcctcggcctcccaaagtgctgggattacatgcgtaagccactgcgcccagcctgtaccacaaattaatggttaaaatgcatccctcatacgacaatgtaacttcttcctctcactgttgatggcctatcttcctgaaaacattaatctgggggtgagaacttgggagatacacacagttgggttcaccataaatgaggagcctcactgacagtggaagatgcacaggaaaagaaagaagactatgggctgcttccttagaattgtcttcctgcttgctgtgttactgctagagcttcctgtgtgggctccatatggtccctattcttcccaccactcatgaaaacaccaaagagcaggttcagagtgaccacagccaagccccagctctgccagcaggcccccatcttctcctgctctgatgtggggattgtgcggttggcttgtttcctggcttctctcttcttcctggcatctctcttcatgttgctaggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggtgagtgaagaaagccaggtgggtggcagacagaatgctgtccccatggggtcctgtttgggtggtggcttcaggggctttgctgaaagaggttggtgccactgtttatggctgtggtcagtatgaagatgatggactctgcctttcttcataagcattcagtatcttatatagctaaaatttaccttctaaaggtagtacttatctttacatttgagtttttccaggataaattctttataaagaaggcagagatcacatttacaaaattcagagctcaggccagatcctctctgaagtcatttgtttaatctaagctccaacctatagactcactcagttgcatttgcttttagaataaataattatatgagaggccttcaaaaagttcatggaaaaatgaaattaaaagagattagaaacataaaatataaactttatttctcaacataagctccatcaagttcagatgcttttgtaaggcttcataccaaccctttaatccatctgtaatgaactgagatactgggaatttaatcttaaggcagtctttttaatgttatttgctgaagaaaaatgggtgccctgccaagaccagcttggtgggggagaccctaacccagcagagctagaggaattaaagacacacacacagaaatatagaggtgtgaagtgggaaatcacagccttcagagttgagagccccaaacagatttacccacctatttattaacagcaagccagtcattagcattgtttctatagatattcgattaactaaaagtatcccttatgggaaaggaagggatgggccaaattaaaggaataggttgggctggttaactgcagcaggagcatgtccttaaggcacagatcactcgtgctattgtttgtggcttaagaatgcctttaagcggttttccgccctgggcgggccaggtgttccttgccctcattccggtaaacccaaaaccttccagcgtgggcattaagaccatcatgaacatgtcacagtgctgcagagactttgtttatggccagttttggggccagtttatggccaggttttggggggcctgttcccaacagtgccctttaaaggttttttaagattaggaaacaaaaagaagtcaaaaggagctaaatcaggattatagtgattttccatcaaaactcttgcaaaattgccattgtttgatgagaagattaagcaggagcattcatgtggtggagaagaactctacggtgaactttcctgggctttttctgctaaaactgtggctttctcagaacactctcaaaataagcacatgtgggccaaggatgtttctccccaatgttgtaaaaatgaatgggtgtaattagtcaagggcaaattgtaccctacaccttcagaggcccttgctctcctcccccaagttacgagcatctatagttatccctccctcctgccctcgctccctccctcactctcacctatctatcatctatctatcatctatgtatctattttctatctatctatctatcatctatctacctatatctttaactgagagatttctcgtagcttttctttatagagcaaaggtaagttagagtagaaacacctgtctctgttatgtcaagtccttctgggctaaaaaactaggagcttaggaatatgggttccatctctagttcctgatagttcactgtgtgtctgctgaaagattctttctgtatttaaatgttttgattttatgacttaatgttttccccaaatataaaaattgtgttcctgtgtaacacatcacataaagacaacaaaaaatataagaaaatgtaaacaaaattcatgtgtaagatactccaccctcaaaaaccccactgggaacatctctttttttttttttttttttttgaggtggagtcttgctctgtctccaggctgaagtggcacgatcttagctcactgcaacctccgcctccctggttcaagcgattctcctgcctcagcctcccgagtagctgggattacagcctcccgccaccatgcccagctaatattttgtatttttagtagagatgggatttcaccatgttggtcaggctggtcttgaacgcctgaccacaggtgatccacctgccttggcctcccaaaatgctgggattacaggcgtgaaccaccatgccagacccattgttttatttttaattgacatataataattgtacatatttatgggatacatactgatgtttcattatatataatatacagtgatcagatcagtataattaggaaatccatcatctcagacatttattatttctttgtgttgggaacattcaatatcctccttctagctttttgaaaatatgtcatatattattgttaaatatattcatcctacagtggttcagaacactataacatattcctatgatgcaggtgtaattttattttctacacttttattttagattcaggggtagttgtgcaggtttgttatataagtaaactcctgtcatgggggtttgctgtatagattgtttgtctcccaggtactaaacctggtatccaatacttatcttttctgctcctccccctcctccctccctccaccctcacgtaggccccagtgtctgttgtttccctctttgtgtccatgtgttctcatcatttagctcctacttataagtgagaacatgtggcatttggtttcctatttccgtgttagtttacttaagataattaggccttcagctccacccatgttcctgcaaaaacatgatctcattcttctttatggctgcatagtattccattgtgtatatgtagcacatttctttatccagtctaccactgatgggcatttaggttgattccatatctttgctattgtgaatagtgttgcagtgaacatacatgtgcatgtgtctttacaatagaatgatttctattcctttgggtatatacccagtaatgagatggccgtggttggagagtggttggtatgagttcagttcttttgcatttgctgaggattgttttacgtctgattgtgtgttccaattttactgtatgtgctgtgtgtgatgagaagaatgtatatttttctggttttgggtggagagttctatagatgtctaacagatccatttggtctagtgttgattcgaggtcttgagtatcttcgttaattttctgcttcagtgattactgtcagtgaggtgttgaagtctgccactattattgtgggggggtgtctaagtctctttgaaggtctctaaggacttgctttatgaatctgggtgcccctgtgttaggtgcatattatttaggatagttaagtcttcttgttgaattgagccctttaccattatgtaatgtcctttttgtcttttttgaactttattggtttaaagtctattttgtctgaaattaggattgcagcccctgcttttttctgctttctatatgtttggcttccatccctttattttgagcctataggtggcactgcatgtgggatgggtgacttcctttttctttgtttgtttagcggctcttttaagattgctgcaggatattgtctcatactttaagcagtcctgcatttgttaagtccagtcacaaggtaaggtttgaggagctcataataaatgaaatgcacaattatataatcttttcaattcctacactagtgggtggaggatagggattcaagaaggcagaggtcacaccaactggacttgtgaccacgagcaggtgctggctaatcctgaaagccactggatcttgtctcttcgctttctgtcttctaggatggcagtgctccctatggggccaggtatgtgggctccatggtggctgacgtgcaccgcaccctggtctatggaggaatcttcctgtacccagccaaccagaagagccctaagggcaaggtaattctcccttgtccactggctgtgcatccggtcagggaggtgggggagctccctcccgtcacacctgctgtttggctactgcactgcttcatggcatgtctgtgtggggatgggcaggggaggaaaaatgaactctgtttcccttgagtgagtctccaggctgtgggaggtttgaagaagaaggcgacaggctgacgttatgtgactggtgattctcactggtcttaccccctccagcctcacacccaccgttcaccatgaaccagctgtgtgtctcactttccacaggctgcatctgacttttagcttcagcaccagctgatctgggatgatggtccctatagggagcctaataaaacttatcaacacacttcccagaacaaatgcatgtaaacgtacacattacatacaaattacacgttgagggagttcactgatgccctgaagtccgcccaagtatcccctagagaatttccaaacctcagaataagaacttctactcagaactcagccaatatatctggaaaggtagttcctggaaggtctaattgcaacttaatgatgcaaaacttaaaatacttgtattatcaagtgagaaccttatgatccagctatcttgcagagaacctcccataaaaatgcatctgaattttagccaatcacagaaatcgtaggtaagtagtcaaatcaaataaaggcctctgttttctctgacacaccaacaaccagcgacacatttttctgtctctcagagtcaccttgagatttgaattattcgaatgctaagaatcaaagccacgctgagagatctcacacagcacatgaagccagagagattttaataggttggtgtatcaggtgtttctcttcatgtgagtgcttagcccaggtgtattcacccactgaactaagaacactgataagcctgcagaagtggtgctgaaggaaagctaagcaccatggaggactaagtgaggcaagtagaagacatggacaatggacattctttttttttttttttttttttttgagatggagtcttgctctgtcgcccaggctggagtgcagtggcaccatctaggctcactgcaagctccgcctcccaggttcacaccattctcctgcctcagcctcagagtagctgggactacaggcgcccgccaccacgcctggctaattttttgtatttttagtagagacggggtttcaccatgttagccaggatggtctcgatctcctgacctcgtgatccgcccgccttggcctcccaaagtgctgggattacaggtatgagtcacagcgcccggcgaagacatggaaattcttagaaccactctggtcacttactcagttacattggggagaacataaagatcagttattactaattattcaaatgatcgtaaatgagtcagaaaatactcacatgggatcacatactcatgtcccttaagcacatgtcactccatagatagatctgcgtttgctgcgcataaccaccacccatactgaaagttctgttggatcctaatctccgcatttctgctgtcatggtccctgtgccgacgtctctgtgtgtgtgtgtgtctgtgtgtgcatgtgcacactcctatcctgtgtgtgtctgcatctgtatagctgtgtagatttaattgcagagaaagtacaggtcatggctggctgcggtggctcacgcctgtaatcctagtactttgggaggccaaggcgggtggatcacgaggtcagaagatcgagaccatcctggctaacacagtgaaaccccgtctctactaaaaatacaaaaaataattagccaggcgtggtggcatgtgcctgtggttccagctactcgggaggctgaggcaggagaatggcgtgaacctgggaggcggagcttgcagtgagctgagatcgcgccactgcactccagcctgggtgacagagtgagattccatctcaaaaaaaaaaaaaaaaaaaaaaaatacaggtcacatgtcacatggcctgcaggccaaggtgccatgaagccctgggcattttgatattaaatttcctacaacaggggcatctgaggtcagaacaaaagtaacttggctccaagacaagcgcattaggtactaatgctgagctttttttgattaaagtagttgactcaacaggataattgattacaatctgagactttattatctgataccccaaatcccccacataaaaggggagaaaaatgctgagcgctataagctgtcaaggtgagagtctccttggctagactgtcctggacagcatggcctccagtgtccctcctgtgggtaatgagggacagaactatctgcccccagacagcccgcatgcaccacaacttttttacacccttctggacacccactactttaagagccagaggtctagggtgagggcaccttacactgaccaaaatggcagtaaatacccccatggagtcttcacctactttctctcgaatgcctggatctccagcctagaccaaaggcatcatgttcctctccttaatatatataatatatacaatagaaaaaatatataataacattatataaatatataacatattatatgtaaatatatattatataatatataataacatataaatatataatagaaaaatagaaaaaaattaccataatatatgactctttctcaaagtagtttaaacatatcaccaaaacggactggaagaaaagaatggtaaggaaaggctgcacatagctgggtcaaccatttcgtaaggtgataatggagaatgaacttttgggaagttacacaggttgcactgatggggagaaagaagaagatgatactgagtcatgcacagcagcagggcctcggccagaacgacaccctgaatctaaggtgatgggggtgtgtgttgtgagtcaggctgggggcgtcatgacatcatcacagaaatagacctaaaaagtccattcaatccaaccccattcatttcaattcactgcgtactcacaggacacaggcagcctcctgccagttctcatgtgcctgcaggagggttagagaaggccttccttcctctgaacagcagccctggatcttgtgcagagactggcaagcagggcacaggctgatttcaacccagtttctgccctcggctgggacccctcgtgcaggaaacagtggccttgcttggacactttcttcgtttttgagacaggctcttgctctgtcacctagactggagggcagtagcatgatcacagctcactgcagccttgaactccggggctcagttgatcctcccacttcagcttcctgaatagctaggatcacaggtgtgcgctaccacacctggttaatttttaaattttttgtagagatggggtctcactatctcaaatggggtctcaaatgcctggactcaagcgatccttttgcctcggcctcccaaaatcctgggattacaggccggagccaacactttctctgtgtcggcactactgagaatacagatagtacagtgaccagctaggatggacagcagcctagagaggaagccaggcattaaagaggcctcagtgtgatgagtggtaccagaggggaagtacaggatgctatgggagtgcaaacgatgggatttcacttagtctaagggtcaaaagacaagaccattgaaacaccggcaaactagttagacaagtcaaagcttaagatgtggagttcctccacacaatcccagccactgtggctgtccccagagagacaagccggcatggtcaaggtgaccttactgtcccatccaagcttgactctttaccagccttgaggtctcacatataaaggcttccacccaggcctgcagcatcagtttgcttcttgttgaaccaagaaatagatgcctagatctcatatttccaagtcaagaggcaggtctctcataagcacaaggatcacaagatgggtagatacatggctcagtcacctggccagaggggcccccaaggcttctggatgagtgccatctgatgcatctggcctgctgtaggctctaaagctcgggcccactcttgcaaggtgcatggtgcgctcatgctagccagatggaagcaccgcagtacaaactcctcccccagctttaggggcatggctcgggacatttggccacttgcagagtttactcacctgcctctgttcctccacagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaagtgcgactttggcttgtcttctgtcagaaacagtggcaaatatggttataattccgtctgtcaacccacataattggcggctgcatgcttgtgggcaaagagtacatagattagttaagaatttgtcagctgggtgtggtggctcatgcctgtaatcccagcactttgggaggccgaggccagcggatcacggggtcaggagatcgagaccatcctggctaacacggtgaaaccccatctctactaaaaatacaaaaattagccgggcgtggtggcgggcgcctgtagtcccagctactcgggaggctgaggcaggagaatggcgtgaacccgggaggcagagcttgcagtgagccgagatcgcgccattgcactccagcttgggtgacagagtgagattccatctaaaaaaataaaaaataaaaattgtcttgattggcttgaaatttgaacctagtgtcttatcctgtagtgattacctccctcaaacacatgtaaatttccaacttaatatcttagaagagtatttgtgtcttattttggataaatttgagttagaaatctcatggcaattaaattctgaaatttctgattgagcctatcttaagagtctataatttggatgaccaatcacagtttgaatggaaaatggggtcacttattgttaaagccagaaacagagtcaatatttagaaattaactacttttctaaacctcttaaccttgcattttcagtttttggggaaatgttttaatctattctagggactaactggtgtacactggttaaatgactcgtcacttgtccaaattatgttaagactggggaggggttggcttatgcatctgaaatctcatcttgttttaggaagaattgctctgaatatctatggacctggaggctaagaaagacattcatgaaagattgacaaatcaaatcaaatccagaagtatttaaagcaaaggtgcatcaggagaaagtcaggcttaacctagaaattcaagaatgattcaacacggaaaaatctattacagtaattcattaggttaggggaaggcagtgtcgggtgggaccaggcaaggccctggaggaagcaaggctctcctttcccactttagcttgggcagggtggggcatacagcccacagacacatttcaacttgagtgtcattctgtacgcaacatcgttcctcagtctagcatggcttggcaactttagcagacacagcaaaatcttattacacaaccaaaaaattttcaccttctcaaaaaggaacaaagattttcttcttttcccaaaatgaaaacttcataaaacatagatgaaagatattaaagcagacacaagtaaatggaaagatatcccatgtccatgcactagaagaatgttaaaatatctatatcacccaatgcgatctacagaatcaatgcaatctgtgttcaactacaagacattcttcatttaaatagaaaaagaatcttaaaattaacatggaagttcaaaatacctcagatagacaaaagaatctggaataaaaagaaaagctggaggcatcacactacctgatttcaaaatatactacaaatctatggtaagcatggtactatcaaaacagtatggtactatcaataaaaggggcaggggagagacagagagatgaacgaatgagacagacagacatagacaagtgaaacagaatagagaaatcagaaataaattcacgcgtttacggtcaactcatttttaacaaaggccccaagaacacacattcgggaaggacaatctcttcaataaactgtaccaggaaaacccaacacccacatgtacaagaatacatctaggccattaccttaccatatacaaaaatctactcaaaataaagatttaaatgcaggacctgaaactatgaaactaccagagaagaaaacataggataaaatgcttcatgaaattggttaggacaaggaattttcaaatagacatcaacagcacaagcaac

SEQ ID NO: 14374 - DNA, 112623 bp, Human
  misc_feature (1)...(112623): n = A,T,C or G
ttcttatgtcacatacgcattttctcttcaggagtggttacggtactcaattctacccaatcagatgttttaactgttgctttaaaaactggaagtgagagaagagagatactttctctctggtaggaacttggtaggtgtgagcaacttgtaacaggctacggtgccaaaccagcagaacatgactttgagatgttctgttagaatgaccctgtctgtattgagagcctgagctggaattcaaagcattcctgttgctggttccatttaatcctatggccaatcatagacctaccctttcacaacttgggttacacaataacttcctgtttttgcctgatctacttcaatctagtttttgtcatttcaaccaaaatatcctgaaaaatttagacaaaaaagaaaaaaataatcaagtgaaaagttttaaaaaaacacatatgcacatttattaaggatgcaaatcttacttttattagcctagcaatttttttaagaacatgtatgtgaaatattttactagtgaaatgaataggacaaagtcctgcttccaggcacttacagacttactaatcctgcaaaatttgtgcctacattaccaatataccttttggcaatatatctctctacatcctccctaggcttatttgacaagtgcaagatagaaatgagttctagaaaatctgatttgtaaaatatatgaatggaagacaagaaaggttaaatggaagaattttgggatattcagatctttaagggcaatcaccaaactctcccataaaatgctcccatcacagttaaaatgcttgctaggaaagactattggtgtggtcctgtggcaattcttttattcttaataagccaaatgtttcttaattccatcacaattaaagtaaaaagaaggggaacttagtttggaataaatcacttcaggtccacagcccaattcactttggattcactcaggcgtgtgtttattttaatagctgatctgaaagcatgtgagatgccacagctgaccagactgtaaacagaaaagcatacaagttaaaaccaagcacgcatgcagcatggaataataatcaagctagactccttatgatgcaaaatgccagaaaacctccaagcattaggtcaaagtttacacaatagcaaaagccttttattctgtttcttagaggggcttgtagaagtttaagattcaagttctaagatagctctacctaaaaagcgaggtcaaagatgggttttcttctcaagatatttgggtaagtttgtacaagacggtttttttttttttttttttttttagaaaaagcagatagttgtcaccaagagttgtccggaaacagtggcaagggaattattcctcaaggaaagtgcaattctctgagctgtaacagtggacaatggtcgaatagtcaccaaccacgatctgggctcacacatagcaaagaggtatattaactaggatgccctacacaggcggtctgtggatgagaaatccctatgcccctcacttcaccagggctgaagagtacgcgatgaggagaaatgactaggaaaaggaataatgtgtggtgaggtatgtatgcgaaagagaaaaaggctggcggggacccgcggtggctaggagagacgtggcggcccaacggctgactacttgggcccgcgccgagccaggctttctccacggtgcgtgtgggagtgcacagaggggcctcgacggcttttctgtatgtgttataaataaaccccaatagtggaaagctccagcaggatgccctgagccctgggtcttcccagcagaagcggtggaggatccgcccctcgtttcccacccccgcgccccaccctgttcccgccccttctctcttaaccccgccccagcccagcccccgcctctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaaataactatgctaatggtttatttactatactatactttttaattattattttagtagtacacttctacattatatattttttaaaattaactgtaaaacagcctcagacaggtccttcaggaaggcaagaagaaggcattgttatcatagggcatgatatctccacccatgttattgcccctgaaaaccttccagtggaacaagatgtgaaagtggaagagtgatattgatgatcctgaccctgtgtaggtactaggctaatgctgtatgtattgtgtacttagtttattaataaaaaaaaaaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatgtctttttttttttttttttttgagacggagtctcgctgtgtcgcccaggctggagtgcagtggcgtgatctcggctcactgcaacctctgcctcctgggttcaagcgattctcctgcctcagcctcccgagtagctgggactacaggcgcgcaccaccatgcccggctaatttttatatttttttttagtagagacggggtttcaccatgttggccaggatggtctcgaactcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggaacatccttgccttttttgctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagnnnnnnnnnnnnnnnnnnnnccccagagccagtcagctgtggtgaggaaggtgggacatgtagcaacataaagctctcctggaatcacatacctggaatctgtgtttgtgtggagcagttccccagaaaaggggaatgctagttccaggactggtggtgggaggctaaccaggtggtaccacagatagtaccattcagtttttgctactgagccatgaggtctgcagagttaggaggttcccacgtctgtctttgtttcccacactacaccatgccggcacctagcacattcttctcctttggaaaggagtatagtgaggaagaagcaacaaaagtgggctaggaaagcaaaggaacagattgttggaagtaactgtgagaatggaagtagcgtcaactcccaactacaaatgtgaaatgcctttgggcagcatgctgcctcaatgctctgtgtgaggcccagggttaaggaacatggccacagtgagcactggttaataaagatggccaggggctgggcgtggtggctcatgcctgtaatcccagcactttgggaggccgaggcaggtggatcatgaggtcaggagttcaagaccagcctggccaacatggtgaaaccccgtctctactaaaaatacaaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactcacggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaannnnnnnnnnnnnnnnnnnngctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgctggcttatttcacttaatgccctcannnnnnnnnnnnnnnnnnnntgacagggatcctttcttttaaggctgaaatgtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaacccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatgggaaaggaacaaccagtaccagccactgcaaaatcatgccaaattgtaaagaccatcgagactaggaagaaactgcatcaactaacgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcaatgtacaaaaatgacaagcattcttatacaccaacaacaggacaaacagggtgccaaatcatgagtgaactcccattcacaattgcttcaaagagtaataaaatacctaggaatccaacttacaagggatgtgaaggacctcttcaagggaggaactacaaaccactgctcaatggaaattaaaggaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacaaggaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaaattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgacccatttgcttattgagagacgtgtgttgtttctagttcatggcttttacaaataaagctgttatgaacactgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaatttttctgtacttccggcatcacctttttccttcctatagaatcattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtaagtaaaaaaaaaaagtaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcatgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcccttttttttttttttttttttttgaaacacggtttcgctcttattgcccaggctggagtgcaatgccatgatctcagctcactgcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccagtagtaaagacacatgacatggtacttattcaagctcagatatgatagaaacagaaaaagtggtggctggtacctattcttagtcttagcctttgttttaatttctactgctttaaaattctttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggataggnnnnnnnnnnnnnnnnnnnnnnnnnnnnnnnnnnnnnnnnnnnnnnnnnnnngtggggtgtgccagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaactcagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactaatccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgattcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgttttcgttttgctctgtttagttttgttttgtttagttttgttgagacagagttttgctcttgttgcccaggctggaatgcaatgacgcaatcttggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatccttaggtttgtttgtttggtttgagtttgatttggcttttatattttttaaaatcccttttgctaccccatctggttttataaactgagtttcttagcattcgttaaaattaaggggtttgtttggaataatataattttttagctttttacttcttacctgattgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctggagtgcagtggcacgatcttggctcactgcaagctccgcctcccgggttcatgccattctcctgcctcagcctcccaagtagctgggactacaggcgcccgccaccacacccggctaattttttgtatttttagtagagacagggtttcactgtgttagctaggatggtctcaatctcctgacctcgtgatccgcccacctcagcctcccaaagtgctgggattacaggcgtgagccactgtgcccgaccaagtttataggttttagaagcccatgctgtagcaggcaagtgataacaggctttaatccccttaaagcctgttgtgggatgggatactggcattgagtggggtaagggtgattaggttttaatgggagagtaatgggtgtgtgatcggttgccagggagggagtagaggtgtctcatacttgtgggttaaggtggggggatacgagaggaagacgtgaaggaggctttgggtttagaagaagggtggcaatgagatgtggctgtagtccaggaatagtcagggaagcagataatttggttaaaatgtctcggcctaataagggaactgggcaggtggggataactaaaaaagagtgcataaaagaacgttgtccaagttggcaccagagtaggggagttttaaggggttttgaagcttggccatcaataccca

SEQ ID NO: 14375 - DNA, 10701 bp, Human
aggggctgcgactcttgggatgggtgagggagtggaggccctgtgtagaggaagctgtcgggtttactatggccaaatttggttgtgaccccaaggaagacaccctctcagtaaggccagagtccctaggattttggcctttcatggggatggggctggtggcgggcacagctctctgggggctctgaaagcctccctctcagggcctcttcagcagatgggccagtatccctggccttgataactggggagagcagctgacaggaagagggggactccctggagtggcctgtcctccagccccagggacccctgggggtaacttcccaaggtgtccatgtcagctagctgagttaccagtcctaacctggctgctggtgggagcccctttaaaaaggcccatctagtggggagaggctgtacacgtggactgtttttttaatctggtcaacttacagcttcagttcttgagtggctgtgagccccagtgccccacctagctggtggccaggcctgggctccattctgggctgctaccctggaggcctgagtgacagggtcaggtggggtgagggaagcagacacatggacaggcaggtttcactgcaggagagataggcagagacagctgctgacagagggtgggaggacattagggttagacacagagcctggaggaccaggagggagaggtagcagttggaaggaaaacagcaagcccaagggggcccctcctcatgcctgggggtgaggtgggtggtgtgtccatgttaacagtgccagggtctgcatcccctgccctctgatcttcttcctgctttcgtggtcccagtccccatcccaccccgctctttctgtttcacagcccctgaaactctctctggccctccccatctcccttctggagtctggacaagtggggtttggaacacttcgctcgatgcatttgcatctcatttacaccccatctgaccacccaggggtagtggcaagggaggaggagccgcctcctctcagtctccacagcccccatgaaccctgactgctgacctcactggggtggggatgggaagaggaggaggtggctgctgacctgggcagacaggaagggaaatgtgagtgcaagtgtcactgccctgacccaccccaggcccccctgggcagcccacctctaacgcagttcccctcctcccaatcagagaatcctggctgtgtctggggcgccccagcaggctgcccttgcctgccctgcctccagccctcaccctgggagcaaattatgggggcagcttggtcagcgaagaccctggatgtggggacttggagtcagccgaggggagtggggtttgggacccaagggtcaaaagcagggacacagggagcagagtggctgagatgagctagtgagtaccaggcagaaccgcccaagaagtggagcctgagaaggaggagcaggaggaggagcagaagtcggagcagggagccgggtaccggacctcaaccaagccgcagagagcaaagccctgggcccccaggaggcagcccttcaggggctgcctgggccaggatgagctgtgtgaccttggcgaggtcatttttctccttgagccacagtggccccatccgtcaagtggggatgaaaggacctgctcaggctgtcttgcagaggagcatgtggatgtgaacatctttgaaaggttgaaaggcgccattaatattcatttttgcggtaccttccgcagccccgaggctcgcaatgccctgtgcggtgcctggcttcagttagcttcctgcagccagacgccaagcccctccgccagagccgcgcagattccggcgcccctgcccctcctacccatcgctcccacccatcgctcaacgctcagggtcaccagccgagggtctggtgggggaggggagacgccggctcaccgcgcctggagcggggggccctggtctgacccacgggcgcccgtttctgcttcacccccgcccacccccagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcaggtgagtgggaggcccggcgaggagggggcgtgcaggggcgggccctgggggacccgcagggaccaggtaagcgagtagcggggattggaaggggcgaggaagaatgattagcagggagcgaggcttcccgggtcgaatgccctctggggaggtaggcttagggggcaccggcctgattcttttgtgtgcccacggtagagacaggctgcggccgtcggcagccggtaccgcttccctgcacgctcccctcacccttctccttgtcacctgctcagtccttctctccacccatcaggttctgggtgatgcttcagtctttggggtgggggcggggcttccagtgggactgagggcagaggtgtaggactgtgttccccaaagtgtggttctccgctgagccttcctgccggcccccgggctgtttcaaagccactccagattttctcaatgggactctctgaccatgggggtggagcttggggatttgccctgtgggtaggtggtctctacccagtcctgctcttaattcttaggcactctggcccaggtctgctctcaagccaccagggccagcccatttccttgctttcctccagcagctggtggcaccctcaaagcccctgctggctcctggcaacagcagtgcccctccgggtttcagtatttagccaaatacacatgctttttttgcacaacagatgggtttctataaaaggtgtaatatcaattttacctcattattattttttacacatcggggaaaaaatcaccacttataggaatcccatgatgaattctttagtaaagtgcatcgtcattttgtacggcaaatggtaattccctgatttatcttgtataaatggagagttacacatagataatctgtttaaaacaaaccagacctttaatgaaatccgcttgttagccttagatttctgcatagggagggggcagtgcttgagaacaccacacgggggcagtatggagctattctctgggctgcgttttcatctcttgacccgccaaggtttttctgggggtttttgggttagttagaagcagctagtgggtcagaaagagcccacatccagctgctactaccccgggcctagtcaatttggcctcagcctgaagtcacacccatgcacattctgggcgcctatggctgcagcatgtccctcaccctgttgccaggtagtcccagggcatgagtacccccagcccatcagcgttctcttccaagcccagggtggctggaaggggtgcaagtcccgccagcttcacaccgtcacctcccgctccatggataggaaggagttcgtctctctccctccctctgagcttaggcccctttggacagggcaccccctgctttccagaaaaggtcttcagaacctggcttccctctcctttgtcctccctcatccccacctttcctcaaacacttctgcagctcgcatcttttggcagcaccgcccccaccagccagtccctcctgtctaaatttctctgtccctgaggatgtggcagggtagaagggggctcccaggccagagaatggatgggtcactcctgtgtcctgagagaggacagagcaccggttccacacaccaccgtcacagcccttgggcgggcagacaagtgggctgtgggaaccccagccaggcgggcggagatgttgggataatctagcaggtggcctcgttacgcccagatctgtcgccatggtaacctggttttttctttaaaaaatgtacagtgccaagaggaggaagatggctgacaaaatcctccctcaaagggtgagtgcctttcacagcagcccccagcccaccccccaccctttgctgctccgccctcccctcccccctcagaagcagagcttcagcatcacagtcactttcactttttgtttaaaaaagctcattaataagtgaggctccgcaggccagagggagggggtgaggtggagggaagcagcagagccactggggccagaacacaggggcctgtcagggggtttgatccaagtggtactatagagctgtgggaccaggagggggcaagagctaggggatcagaagctgccaggcagaatgaaggggatagaaggtggccagagatcctgagcatcctaaagagacccaggtccagctgggtatggggacagcacagttgggacaggtgtgggggctgagcaaggtgccagcagagaagaaagcaccgctgtccaactgtctcagggattgagcccctactaggcactttgcaggggcccaggggaagcccagcaggcatatgatatggacaatgacaagatgaggagactaaaggctagtgcttgctgagctccaccgttgctacctcctccctgatgatgaaacacaaggcacttcctaaagggagaagcaattgttatccctacacagcaaggcccctactgctggataatggcatcctggggagaggtcctgttcccactgtcaaagctacatgcccaaaagtaggatggctcccctgacatcttttgtaccctaggattgcacaacatgcatacattccatggtacaaccctggacttgagcctctgactcctgccctgctcctccttctccagattcgggagctggtccccgagtcccaggcttacatggacctcttggcatttgagaggaaactggatcaaaccatcatgcggaagcgggtggacatccaggaggctctgaagaggcccatgaaggtgccttagttcgggggtaggaaggggactctagagttgtgtgaccaggatggggaagcagggtggtcggggtgggagcacacagcattcgcccggttctgcactctatttctacagcaaaagcggaagctgcgactctatatctccaacacttttaaccctgcgaagcctgatgctgaggattccgacggcagcattgcctcctgggagctacgggtggaggggaagctcctggatgatgtacgtcccggcccaggtctctccaggtgtcctggggtgggcatgggctgcactgagaacagaacaaggtgtctgcactaagggctagggagtcagcccaggctgggtggaggggcaggcctagagacattccaagtgcagaggatttcatctaagcccactgccctgtctgctgccaacttggcctccttctgctcctcccacctcatccctgttctgcccccatggtccctgttgctctcccacagcccagcaaacagaagcggaagttctcttctttcttcaagagtttggtcatcgagctggacaaagatctttatggccctgacaaccacctcgttgaggtaagaccaagagcccctccgcccttgaattgccaccctcccacaggccagaatccctgaagaaccagcacagatttgggtcagggaccaccctagagtcctgggccccaccactccagatgggcctttgggagacacagctcttctctcctggacagtggcatcggacacccacgacccaggagacggacggcttccaggtgaaacggcctggggacctgagtgtgcgctgcacgctgctcctcatgctggactaccaggtctgcacctgccatgctgccccgtacacgccacacaaggccctcagggcagggctaggtcccaaagtggtgcatcttgagagacctccttcccctcccaaacctatccttccccaggggcatgtttcctcaatcaacacatccccctagtcctgaatggcctggccctgggctccttcctttctctccctttggtctaactttcacagtccccttttcccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagatttttgattgtccccggctgaagttttctgagattccccagcgcctcacagccctgctattgccccctgacccaattgtcatcaaccatgtcatcaggtgaggtggccccagcttgcttctcagaccagggaatgatctcgttcctgccttccctgcccctccctctcctcccactcccatctcttctccctccctgttggatctgccccagccccggggccctggggcccgtatgggggcatcgtggacacgaagggctggacttccctggcagcgtggacccttcagaccagaagaagacggcgtgctatgacattgacgtggaggtggaggagccattaaaggggcagatgagcagcttcctcctatccacggccaaccagcaggagatcagtgctctggacagtaaggtggggcccaagcccagagctggagtgggacattaacccagagatgatagaggagacttttctgagaccagggtgtggttgcagatgagcagtctgggttaaattaaaaaaaaaaaaaaaaaagagaccagactctgggccaatgggacacacatggcccgtccatgctgcttggagctgaacctcattccaagtttagttctgcccatcccctcctcccctgggacttcagagaaatcaggggctctgaggggttgtccttcacagaagaaaccccctctccctccccttcccacccgcttcctttcccctcgtctcccacatcaccaaagccaggtggaaagcatctatctttctacctgcagatccatgagacgattgagtccataaaccagctcaagatccagagggacttcatgctaagcttctccagagaccccaaaggctatgtccaagacctgctccgctcccagagccgggacctcaaggtgaagagggagactcagggagtactggagtggaagacaagcacagcgggaaagagagtaaacgttgtactccaggggcaggtgaggggattcagggctcagggctcaccccacgctccctcccaggtgatgacagatgtagccggcaaccctgaagaggagcgccgggctgagttctaccaccagccctggtcccaggaggccgtcagtcgctacttctactgcaaggtatgcagggacccttgccctgaggcttccccatcctcaactccaagagaaacctccctgttcagcttgtgggcagccctcgcagctccccacagtaaagcttcaccacgctgcctcaccatgcaatggccctccctgctcccagatgctctttcagggcaggcggtgtcagtaggtgggattgtcctgatcactcaccagaacactgacacctgctcctgttctcacttcctctaaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacagcagccgtgtggtcattggaaactggggaggggagggggagagaaggggaagggaagaaggtggggaggcagtgggtccctcgggacgactccccattcccttcccttggattcttctccttactcaattttccctagacctaaaaacagtttggcagaagacatgtttaataacattttcatatttaaaaaatacagcaacaattctctatctgtccaccatcttgccttgcccttcctggggctgaggcagacaaaggaaaggtaatgaggttagggcccccaggcgggctaagtgctattggcctgctcctgctcaaagagagccatagccagctgggcacggccccctagcccctccaggttgctgaggcggcagcggtggtagagttcttcactgagccgtgggctgcagtctcgcagggagaacttctgcaccagccctggctctacggcccgaaagaggtggagccctgagaaccggaggaaaacatccatcacctccagcccctccagggcttcctcctcttcctggcctgccagttcacctgccagccgggctcgggccgccaggtagtcagcgttgtagaagcagccctccgcagaagcctgccggtcaaatctcccccctataggagccccccgggaggggtcagcaccaggaggggagggggggtcagggccagcccccgggggccctgggggtgatctctgtggtgacagggcaggattgaactcctggaaatggactggaaagaaggcctgccagccagagatggcattcatgcgacagcggttgaggacttcgggcccaggccttgtccacacggtggtaaggaagaagagagtgtccacagggtgcttcttcgagaccacgtccatgagtcgcacctgggaaggggcctctgctcgcacagcgagccaggccagcctcgtcccagggtaccgtcgctctaactccgctgctgcagccttcaccccaagaaatgggtctggagctccacggccaccttctcgtggcccgtagaccagcaacagggtgagcaatgcatgttctcgtggctccaggacattggctgcaaaggcctcgaggaaagccggggctgcagcagcttcagccaccaggagtggcagcaccagctgcactcgggtggcctcagtgacatagggcataggtaggatttccacccggctcagtggccgcagcaggctgaccctgcgagccagggcccgccggtgcccacgctgtgtcacacattccaacagcaggtccagggtgtactccatgccccgtgctgggtcgaagcgccgatagccgttgagcagtcgctgcttctggaagcgcaggcggggctgatagcgccgattgagctgctccagggcagtctccaacgcatcacccacgtccgccctgctagccccctgtagtgggcacttgggagccccatctgcacaggagaaggtgtgctgctctgtgaagtagtcccagcccagcacctcaaagcgagagtgtggtgtgaaaggagcagggagcccaacgggccagctcagccctgcctccccttcgggggtcagcacggtcaggttccggatctgagcctgggttggagggaatgcacctcacattagtgccagctccaggatcctacccagctccagctgcctgggctctgagattcaaacagctgagctctgtcctaactccatcaacacttagtgaggggtcccttgctaatcactgaatcccttgtacgttattcttcacctctaaaatgcagatggaataggaatcatactcaccttacacaaatgccatgagaaggaggtggaaaatgtgctttttgcacaggtaaaagtatcttgaaatagaagctcaacagcctttctctcctacacccaaaggactcacatcctcttcataatcacacctttgttttcatctacactccacctctgccaagcctgacgttcaacttgagaattctcccttctaccct

SEQ ID NO: 14376 - DNA, 197337 bp, Human
  misc_feature (1)...(197337): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgca

SEQ ID NO: 14377 - DNA, 9931 bp, Human
  misc_feature (1)...(9931): n = A,T,C or G
acaggcgtgagccactgcacccggcctggtattttcatttattaaatccggcatccttacccacaggcctgactcttgtcttttccctggagttgtattttcctggcctagcccagagcccaccatttacaaggtgctcagtaattgttctatatgaatgtactatctgcatgctgttttgtacgttttttactcatctgaaatttacatgtatttatcagaaattcccacactcactaaaaacacttgttaaagacaatttttgaaaatatattatattgccaaaacttctttgttttccgtttctgcaaaattggtatagtaggagtatctaccctcatcacattttgacaattagaagagttaatggaaaagtaaaagtaaagttttgcaccgtgcccggcccactaggacgctcaataaacttcagttctttattaaaggaagcctgtgcaccattttagcgtaaagcaaaaaaagcgcgtttgtaaagaacgggtgggggtagagaaaacggttagaaaggtctgtcgacccaacaccgagggcccgggaaaaagggaggagagaagggtgaatgacagaggagccagccaatggggagactgggaactacttcccccctccctttgcgtttcaaattctaagctccgtttccatccgggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccggtacgtgtctcctttcctcagtccgtttttcgtgacactctccccgtgttaggactggggattatatctccctggagatgggggtggcgggcgccattttaagaacccaaaggttccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccactgagcctgtctcccgagttctaagcgatttttctgcctcagcccccccccccccccccagtagctgggattacaggcatgcgcgaccacgcccggctaactttgtatttttagtagagacagggtttcaccatgttggccaggctggtctcaaactcctgacttcaggtgatccagctgcctccgcctcccaaagtactgggattacaggtgtgagacactgcgagccactgcgcccagccaacatgatacattttatcttgagatccataagccatattttgataacttggcttttggttttggctactagttttgataacaagctgatacctacttggccttgttttaaattttaccatacaataatgcagtgggttcaccttatgtttcaatccagatcatcagtatcggttttaagtattaagaattttaagcggaaaagccccatttatgtaaactgactatatttgcagtgttttttcttagactaatgagcaacacttacccataactgcattttgaaggaccagttagtgtcttagtgcatagtagatgtgcaaattatttttaaatcttgatttaatttaatcgtatctttttttttagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatgggtaataacttgcgtggacctcgggtttggtgtataagttagggactgcaagctcacaccaagtggatgctttggttaagtccttgaggaaaggtgccaacttttgaaattgacaacacttgttcatctaccaaagtgattgccaattgaaagcatgggaagcatgttttagattatggtgttaaaccgtggacagtgttacttcttgtccaagtagttcactctgtaggaaaggcatttaaaaattgataggccagggtgttggacatgaaaatgaaatcatttttattttttaaagttagctgggcgtggtggcaggtgcctgtaatcccagctactacggaggctgaggcagaagaatcacttgaacttgggaggcagaggttgcagtgagttgagatcgtgccactgtactccagcctgggggaacagcgagactccctctcaaaaaaaaaaaaaaaagttttttaagactaccttcagttcttatttccccagtttctatgactgcagtgcatgctccatcaagtacaagtgaaactagactacccaaatcaataatggtttttttttgggggggggggnnnnnnnnnnnnnnnnnnnncatcaggcgattgtcctgcctcagcctctcaagtagctgggattacgggcatgcaccaccacacctggatttttgtatttttagtagagacaggattttaccgtgttagactggtcttgaactcctgacctcaggtgcccgaccgcactgtctttacgagtagctgggattacacgcgtgagccattgtgcccggcccaataatggtcatattcttgatgaagcaaagaaaacttttatagtggccgagcctggtggctcacacctgcaatcccagcactttgggaggctgaggcaggcggatcacaaggtcaggagttcgagaccagcctggccagcatggtgaaatcctgtctctacttaaaaaaaaccaccaaaaattagctgggtgtggtggcgcacacctgtaatcccagctactcgggaggctgaggcaggagaattgcttgaacccaggaggcagaggttgcagtgagccgagatgaagccactgcactccagcctgggcgacagtgagactctcaaaaaaaaaaaaaaacttttatatctttcttgattcttgtgagtagtaatatttttcttttctatttttgatgcagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagaggtaaatgttccatgtatgatgatttatgctactaccgtaacacaaagaattgagaggtgaatgatgcttaaaattttaattggccaggcgtggtggctcacgcccgtaatcctagcactttgggaggccgcggcagacggatcacggtgtcaagagatcaagaccatcctggccaatgtggtgaaaccccgtctctactaaaaaatacaaaaattagctgagtgtagggcgggttcctgtaatccccgctacttgggaggccgaggcaggagaattgtttgaacctgggaggcagaggttgcagggaaccgagatcatgccactgtcctccagcgtggcaacagagtgagattctgtctccaaaaaaaaaaaaaaaacaaaaaaaaaaaactttattcatggagtctgggtgcggtggctcacgcctgtaatcttgacactttgggaggctgaggtgggcagatcatgaggcccggagttcgaggccagtctggccaacgtggtgaaaccctgtctctactaaagatacaaaagttagctgggcgtggtggtgggcacctgtaatcccagctactcgggaggctgaggcaggagaatcacttgaacccagaaggcagaggttgcagtgagccaagattgcgcgactgcactccagcctgggtgacagagcgagactcccatctcaaaaaaaaaaaacaaaacttttagtcatgtgttctaggtgattagataaatggaattagcactgaaaaaaatttaaaatatgaatgggaaattgtagaaaataaaattaggtgatctagcctccgtaatgtcatctttgaagtcagtctcattatttttcatagcctgaatgtaagttcacgttttaacttttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacaggtaatagaaaagtgcagctttttaaattaataattaaggttgaaggaaagcttatcaaaagcataaaccaaaacttttgctttgtagctattcaagcagagattacccaagttctcgtgatactagagattatgcaccaccaccacgagattatacttaccgtgattatggtcattccagttcacgtgatgactatccatcaagaggatataggtaagtgactttgcttctgtggcttacatgtaagaaaagttgcaatgaaagttgattctctgggacttaaaggtttctctttaatttagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaaggtaagtgttgaaagcaatggcctttgaaggtttaaatgttgtgtaactaccatttagtttagctgtgacattggcaagttattgtggtcctcacttcatctgtaaaagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactagaaaaaaaaaaaaaaaaaaaaacaccgggcgtggtggtgtgcgcctgtaatcccagctactggggaggctgaggcagaattgcttgaacccaggaggcagaggttgcagtgagccgagatcacgccattgcactccagcctgggcaacagcaagaccctgtctcaagaagaggaaaaaaaaaatttgctcagtgcattttgtaaaaggatatactttcgttgttactagttagtgcttgctcatttgcatagctacaatacaaattgactaaatgtggagttaatgatgcaactgtggctgcaagctccctgtttaacataattgtattgacattgacataatgacgacatagtatgtaatttcaatattaccttttttt

SEQ ID NO: 14378 - DNA, 11194 bp, Human
  misc_feature (1)...(11194): n = A,T,C or G
tgtccactgccgccaccctgattcaagccaccatcctctctttctggtctgctcccacagccctattagtgtcctttttcccacacttaccccctacagtcatttaatgggctcaaaggtcctgccaatcttggctccctcatttcatgcccctcatattcttgtcacctggccctctttctgtcccttgatatatgccaagctcttcctctctactttgtgtttactattctcttcttttcctgaaggtttttccctcagctgttcccatagctagtttcttttcttccttcagctctgatctccaaagtcacctcttcacatagaccttccctgatgttttaatcaaatttgttctccctaatattgtccatcaaagcaactagtttatttcctccctggcattaatcacaacatgccattcttttgttaattgtattcaatttctttaagaaaaaaattaaaaaattttttggtttcccccctcaacaagtaggatgggcagatgaaatatagaatgctcagttaaatttgaatttccgataaacagcgaatttttaaaatatgagatttgggacatactatactaaaaaaagtattcgttatctgaaatttaaacttaactgggcgtccctttttttttttttagacgaagtctcgctctgttgccaggctggagtgcagtggtatgatcttggctcactgcaaccgccgcctcctgggttcaagcaattctcctgcctcagcctcccgagtagctgggactacaggcacacgccgccacgcccggctaatttttttattttttatttttattttagtagagacggggtttcaccatgttgcccaggctggtctcaaacccctgagctcaggcaatctgcccgcctcggcctcccaaagtgctaggattacaggcatgagccaccgcgccccggccgcgtcccatatttttatttaaaattttttaacagcttcgcagaataaattagcgtcccgcattttcttttttattttgagacggagtctcgctctgtcgcctgcccaggctggagtgcggtggcgcagtcttggctcactgcaacctccgcctcccggattctcctgcctcagcctcccgagtagctgggactacaggcgcgtgccaccacgcctgggtaattttttgtatttttaaaaagagacggggtttcaccgtgttagccaggatggtctccatctcctgacttcgtgatccaccgaccttggcctcccaaagtgctgggattacaggcgtgagccactgcacccggcctggtattttcatttattaaatccggcatccttacccacaggcctgactcttgtcttttccctggagttgtattttcctggcctagcccagagcccaccatttacaaggtgctcagtaattgttctatatgaatgtactatctgcatgctgttttgtacgttttttactcatctgaaatttacatgtatttatcagaaattcccacactcactaaaaacacttgttaaagacaatttttgaaaatatattatattgccaaaacttctttgttttccgtttctgcaaaattggtatagtaggagtatctaccctcatcacattttgacaattagaagagttaatggaaaagtaaaagtaaagttttgcaccgtgcccggcccactaggacgctcaataaacttcagttctttattaaaggaagcctgtgcaccattttagcgtaaagcaaaaaaagcgcgtttgtaaagaacgggtgggggtagagaaaacggttagaaaggtctgtcgacccaacaccgagggcccgggaaaaagggaggagagaagggtgaatgacagaggagccagccaatggggagactgggaactacttcccccctccctttgcgtttcaaattctaagctccgtttccatccgggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccggtacgtgtctcctttcctcagtccgtttttcgtgacactctccccgtgttaggactggggattatatctccctggagatgggggtggcgggcgccattttaagaacccaaaggttccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccactgagcctgtctcccgagttctaagcgatttttctgcctcagcccccccccccccccccagtagctgggattacaggcatgcgcgaccacgcccggctaactttgtatttttagtagagacagggtttcaccatgttggccaggctggtctcaaactcctgacttcaggtgatccagctgcctccgcctcccaaagtactgggattacaggtgtgagacactgcgagccactgcgcccagccaacatgatacattttatcttgagatccataagccatattttgataacttggcttttggttttggctactagttttgataacaagctgatacctacttggccttgttttaaattttaccatacaataatgcagtgggttcaccttatgtttcaatccagatcatcagtatcggttttaagtattaagaattttaagcggaaaagccccatttatgtaaactgactatatttgcagtgttttttcttagactaatgagcaacacttacccataactgcattttgaaggaccagttagtgtcttagtgcatagtagatgtgcaaattatttttaaatcttgatttaatttaatcgtatctttttttttagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatgggtaataacttgcgtggacctcgggtttggtgtataagttagggactgcaagctcacaccaagtggatgctttggttaagtccttgaggaaaggtgccaacttttgaaattgacaacacttgttcatctaccaaagtgattgccaattgaaagcatgggaagcatgttttagattatggtgttaaaccgtggacagtgttacttcttgtccaagtagttcactctgtaggaaaggcatttaaaaattgataggccagggtgttggacatgaaaatgaaatcatttttattttttaaagttagctgggcgtggtggcaggtgcctgtaatcccagctactacggaggctgaggcagaagaatcacttgaacttgggaggcagaggttgcagtgagttgagatcgtgccactgtactccagcctgggggaacagcgagactccctctcaaaaaaaaaaaaaaaagttttttaagactaccttcagttcttatttccccagtttctatgactgcagtgcatgctccatcaagtacaagtgaaactagactacccaaatcaataatggtttttttttgggggggggggnnnnnnnnnnnnnnnnnnnncatcaggcgattgtcctgcctcagcctctcaagtagctgggattacgggcatgcaccaccacacctggatttttgtatttttagtagagacaggattttaccgtgttagactggtcttgaactcctgacctcaggtgcccgaccgcactgtctttacgagtagctgggattacacgcgtgagccattgtgcccggcccaataatggtcatattcttgatgaagcaaagaaaacttttatagtggccgagcctggtggctcacacctgcaatcccagcactttgggaggctgaggcaggcggatcacaaggtcaggagttcgagaccagcctggccagcatggtgaaatcctgtctctacttaaaaaaaaccaccaaaaattagctgggtgtggtggcgcacacctgtaatcccagctactcgggaggctgaggcaggagaattgcttgaacccaggaggcagaggttgcagtgagccgagatgaagccactgcactccagcctgggcgacagtgagactctcaaaaaaaaaaaaaaacttttatatctttcttgattcttgtgagtagtaatatttttcttttctatttttgatgcagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagaggtaaatgttccatgtatgatgatttatgctactaccgtaacacaaagaattgagaggtgaatgatgcttaaaattttaattggccaggcgtggtggctcacgcccgtaatcctagcactttgggaggccgcggcagacggatcacggtgtcaagagatcaagaccatcctggccaatgtggtgaaaccccgtctctactaaaaaatacaaaaattagctgagtgtagggcgggttcctgtaatccccgctacttgggaggccgaggcaggagaattgtttgaacctgggaggcagaggttgcagggaaccgagatcatgccactgtcctccagcgtggcaacagagtgagattctgtctccaaaaaaaaaaaaaaaacaaaaaaaaaaaactttattcatggagtctgggtgcggtggctcacgcctgtaatcttgacactttgggaggctgaggtgggcagatcatgaggcccggagttcgaggccagtctggccaacgtggtgaaaccctgtctctactaaagatacaaaagttagctgggcgtggtggtgggcacctgtaatcccagctactcgggaggctgaggcaggagaatcacttgaacccagaaggcagaggttgcagtgagccaagattgcgcgactgcactccagcctgggtgacagagcgagactcccatctcaaaaaaaaaaaacaaaacttttagtcatgtgttctaggtgattagataaatggaattagcactgaaaaaaatttaaaatatgaatgggaaattgtagaaaataaaattaggtgatctagcctccgtaatgtcatctttgaagtcagtctcattatttttcatagcctgaatgtaagttcacgttttaacttttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacaggtaatagaaaagtgcagctttttaaattaataattaaggttgaaggaaagcttatcaaaagcataaaccaaaacttttgctttgtagctattcaagcagagattacccaagttctcgtgatactagagattatgcaccaccaccacgagattatacttaccgtgattatggtcattccagttcacgtgatgactatccatcaagaggatataggtaagtgactttgcttctgtggcttacatgtaagaaaagttgcaatgaaagttgattctctgggacttaaaggtttctctttaatttagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaaggtaagtgttgaaagcaatggcctttgaaggtttaaatgttgtgtaactaccatttagtttagctgtgacattggcaagttattgtggtcctcacttcatctgtaaaagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactagaaaaaaaaaaaaaaaaaaaaacaccgggcgtggtggtgtgcgcctgtaatcccagctactggggaggctgaggcagaattgcttgaacccaggaggcagaggttgcagtgagccgagatcacgccattgcactccagcctgggcaacagcaagaccctgtctcaagaagaggaaaaaaaaaatttgctcagtgcattttgtaaaaggatatactttcgttgttactagttagtgcttgctcatttgcatagctacaatacaaattgactaaatgtggagttaatgatgcaactgtggctgcaagctccctgtttaacataattgtattgacattgacataatgacgacatagtatgtaatttcaatattacctt

SEQ ID NO: 14379 - DNA, 5402 bp, Human
aaattgatatactagccaggcttacacctgtaatcccagcactttgggaggctgaggttggaggatcacatgagcccaagagttttgagactagcctgtgtaacatagggagaccacatctctaggaaaaaaaaaatttttttttttttttgagactgattcttgctctcttacccaggctggagtgctgtggcacaatatcagctcactgcaacctccgcctcccggattcaagcgattctcctgtctcagcctcccaagtagctgggactgcaggcaaacaccaccatgcccagctaatttttgtatttttagtagagacggggtttcaccatgttggccaggctggtcttgaactcctgacctcaaatgatccacccccatcggcctcccaaagtgctgggattacaggcgtgagccaccgcacccggccacaaaaaataaatttaaaattagccaggcttggtgatgtatgcctgtggtcctcctgggaggttgaggtgggagggtggcttgaccttgggaggtcgagactgcagtgagctgtgataccatcactgcaatccaggcttggtgagacagcaagaccctgtctcaaaaagacaaaaaaaagttgatatataaaacaacctagaaattagtaagaatacagaataaagaacacaaaatttaagtctttttttttttttaaataaaaaagggtttcactttgtcacccaggcaggagtgcagtggcacaaatacaaaacactatagcctcaacttcctgggctcaagtgattctcccgcctcagccccccaggtagctgaagaccacaggcatgcaggcacgcaccatcacgtctggctaatttttgtactttttgtagagatggggtttcgccatgttggccgggctggtctcgaactcctgacctcaagtgatccacccatctcagcctcctaaagtgctgggattacaggtgtgagccactgcacctggcctaaaatctcactctaaagatatatacagatctctcaacccaacaaagagggattcaaagagttaatatagtatatagagagtaacaggatggactcaaagaaactaacttccaatcctggttctgccatttactagctaagcaaaccttatacaagttacttaatcacttaagtctggtttttcctctataaaataggtattaattgaaaattttaaaatttacccctataattttgtaagaaaataaaattactaagcatagcaaggactttctctgacccaagaatactgtgttttctaacaacatctatgaaacattactaacaggagaacatgttagctttcagtaggggaaagcaaatcctagaaccaaaaatatttaagcaaatatttatttttattttttatttttgagacagagtctcactctgtcacccaggctggagtgtagtggcacagtcttggctcactgcaacctctgcctcctgggttcaagcagttctcctgcctcagcctcccaagtagctgggattacaggcacgtgctaccaagcctggctaatttttttatttttagtagagatgagtttttgccatgttggccaggctggtctcaaactcctggcctcaggtgatccgcccatttcggcctcctaaagtgctgggattacaggagtgagccaccgcacctggccataagtaaatattttagaactctccttttagtacatgaaatgaaattcaaatttatgatatacttaattacaaaaaaagtctaactgcaatataaaggagaaacaaaatgaaagtaatttgtaatatatataagtatgcaaacaaaacaatactagaaaacataaaatattcataagtagaatcactgacagtggcagctatgaacaaaatcttccatatattcccataggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttcttaaaaaaaaaaaaaaaaaaaaaaagaatggaccaggccaggtatagtggctcacacctgtaatcccagcactttaggaggctgaggtgggtggatcacttgaggtcaggagtttgaggccagcctggccaacatggcaaaaccccatttctactaaaaatacaaaaattagccaggtgtggtggcaggcgtctgtaatccaagctacttgggaagctgaggcaggagaatcgcttgaatctggaaggcggaggttgcagtgagtcgacatcatgccacttcactccagcctgggtgacagagcgagactgtgtctcaaaaaatagaatttttggactagtggaactacacagcctgctttccatatcagaccattcaacccaatgggattcactgccataatctccatgttatgattttaagccaggcctctcttcacctttcctattccttacatttaaagactccaaagcttgtttactgagcacagatcttggaaaacaggatcttcagacttgggaaagcatgacagtagatgatggaaaggtaaagactcagactagcatctagtagtctcgctacacatggatagtaatgctacgtgcatgaatgtgcaatcatgcaaaaactcaaatcagccttctgcacacacacaatggtagactaagaccttctgttaaaggtccaagcactccaaggaagccagcgccttgaggtaccctcagtatgtgcaagtagttcgatgttactcttagttttcccagcaactctgctctagcatgccctaagtttagccagcagcagatcttactgaattataagatgttgccagaggttcagaaccttggtttttttgagatacgcatttgcattgacccaaaatggagaattaaatgactgtatttttcactggcattagctttgtttccttggcatagtgccagttaattacagcagaccctgcaagaccacctctctagttatttccctgtggaagccttttggttggttttgtttttttggttttttttgttttttttttttttttgagacggagtcttgctctgttgccaggcgggagtgcagtggcgtgatcagctcactgcaacctccgcctcccagattcaagtgattcccctgcctcaacctctcgagtagctggtactacaggcgcatgccaccgtgcccagctaattttttgtattttagtagagacagggtttcaccatgttggccaggatggtcttgatctgacctcgtgatctgcccaccttggcctcctaatgtgcttaggattataggcgtgagccactgcaccctgctgccttttggtttttaatatccaaaattcatacaatgttttactgtagttgcttatataggaaaagctatacatccccaaaatgcaatacaacattatgatatgcaggaaatgtcttgagtaacatttttgacagaatatcagaatccttggtggacattttgaagaatatgcagagcatcacaggggatgtgctatgtattcctgcacacagagcaattgttacttactatattaactatttggagagcagcaagtgtttttagcatctaacatcctaacatgatatttgttatatataggtattttgctgtattttattaatacttagtgaattcgttgagttttacattgacatgtaatacattaaaatttttcccacttaaaatagtggaaaataagcttctgcatagaatgtattcctacatagaatatctgattttcagaaatggattatcaagagagagacagatgtccatattaaaaccagagcattaaggtgaagtgaaaatgactcattggattaagaatcaggagaggtggggctgggcgcagtggcttacgcctgtaatcccagcactttaggaggccgaggcaggtggatcacgaggtcaggagttcgagaccatcctggccaacatggtgaaaccctgtctctactaaaattagaaaaaaaatagcc

SEQ ID NO: 14380 - DNA, 6394 bp, Human
acaggaagtgcccacacagggggtgcctggaaccaccaaggagccacatgggcccccaggcctggggtcagggaggttgatggtgtgggttggggcagcccaggacacctggactggccttggggcatttcctgagcactctcagaagtatctgcccctgcccaggaagggggcaaaagccaccctggagaccctagatgctgggctctgacttagaagccactccactcctggactcttagctttgctgacgtcagagcccaggcctgagtccagctcatccccatccatggaggccccaggatgacctctgacccccatgttttcccatggctctcacttggcaacctggcctctggttggggtcacatcctggcccaccaggggcaggagggtgttcgagggcaaagggccccactcctcatccaccctcctacctgggccccctccccctctccccagcatggccagaccactgccctccagtgcccttagctctgggccgagggccaggtccaaatgtgctctgagtcagggtagggatcactcattcccttgccccgctctcctcccttagatagaagatctggttctggggccactttaccatctcaagcccaatctgggcagacccaggtggggatggttggggaagccaggctccgtcttctgcatgacaaagggtggggctgccctccctcctggcaacacttcagaccattgtaaacagtctcccaatccacatttgttttatttttcgttgtcagatctagcaaataaaaatataggactctggtgaaatttgaatgtcaggtagacaatgaataatttttttggtataattatgtcccaaatagtgccttgtattttatctggtagccctacccctggctgatcacccaaatgttttatttccccagcaaaactcttcaaccagcttacaaatccacattcaggataggggtcctctgtcttgggggattgtccccctgccccagcctagacctgatcacctggattgagaccacctggctccctttagggcatagatcaaaactaggctgtaaataatttgagtgtgccaagaactttgtgaattgcaagacctgactttatatggacattgatcattaactttgtgagcttcgggaagttgacacctctgagcctcggttttttttcagctcaaaaattgggagaggttgccgtgagccgagactgcgccattgtactccagcctgggcaacaagaatgaaactctgtctcaaaagaaaaaaaaattgggggagaaggtagcctggatattcctttcaactctaaactctaattctgtgaacagcagggatgagggagaggatgaggctccttccttattggacaaaaccccgttggaactaaatgctcctaggctcccttgcctaggaaggtccccccagaacagtgggaaatctggtttcacaactggggaccaccagctcaggatctcatgaggccccgggaccctctgagcacgggcccggatgctcatccctgcagactggattggcccttagagccctggcgttgcctgagccattctggttcctgtcagttgtttggttgcagcaaggaacaagactctaggtccacttaccagcagctgggggaactgagcctcttgcagagaacgagagccccacctctactctaggaaatgagctttttaatttaactggtcaggcctcaacccacattaggggttcatgaccattgtatagacagctgtagccagctgttcacagcccagacagacttgccctatctagacagccccctcctcccagctcagggactcgtctggctgtgagcttccaggaggtctcaggggtgtgacctccctccctccttccctccccactccctacctcctccctccaccccaggctataaagctgcccaggcttggctctcagcacatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgaggtgaggccctccctccctgctgcccctggtcccatggggcaggtcagatgtgcccactccggtggtgtcaaagggctcctggccttgcagaggtctgtgggaggctgagtgagggccacggtctaaggggcagtgaggtggggccgggcctgtgaggatggcggggcctcagcatgcagcggtgcatgcagtcaggactccgggggtctgttttcgtactgccactctggtctgagttctacttggagcatattgctttaaaatcatctcacaaccatttgctcacatggaactggggtataactatgtcttgcccatcttccagcattgtgaacatcaaaatgagtcattgtaaatagaagcgtgtttgggtaactgaaaaatactgcacttgagtagacaacctgggttatacctggctgtcaggggtgcagcgggcctgaatcctcctgcagccggcctgaatcctcctgcagcctctcgcctccctagctcctcagtgcccagagctagacccaatgccaggcacctgggtgaggattctgctcccagcatctcagctgaggcaaacttgctagccagggtcccacaggcgcccctgcctgctggatggaaattgttactaaacaaggcccagatccaaggaagatttgtaaactgggtttgccccagaaatagaacagggccggtgtctcctggcctggctgccagctcagtggccctgccatcctcagagctcccctggagtcgggggaggccctgctgaccctgctcttgtccccagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggtgggggtcgcgggggcgcgcagggtagggggagggcgctgctaggcccggcttgggggcggggacgcggggggcggtgcggggtcctcggggcccgtcccagtccccgccctcaagcggcgctgggtctctgtgtcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatgggtaggtgctgagggtcaaactggtaagccggaataaagagacaggcaattacatttattttgaaatggacaacttttcagagtgctgtgggaatgaatgagacaatgtatacaattcttcctctgactcttaggagatcctcagtaaatatcggttattaattttcaagttatttctagctgtccatcctatatcacaaacatccagctttttgaagttgagaggtggatcataaatctccatcccagacgccctctgacctcagccctcccagctgaccgctgaccctgctctctttgcccacacagagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctataattttgtaattttctattttattttaattaattaattatttttgagacagagtctcactctgtcacccaggcgggagtgcagtggcccaatctcggctcactgcagcctctgccttccaggttcaagcgattctcatgcctcagcatcttgagtaactgggattacaggcatgtaccaccacgccaagctaattttttgtatttttattattattattattgagacagctctgtcgcccaggctggagtacagatggcgctatgttggctcactgcaagctctgcctcccgggttcacaccattctcctgcctcagcctcccgagtagctgggactacaggtgcctgccaccatgcctggctaattttttgtattttttagtagagacagggtttcactgtgttaaccaggatggtctcaacctcctgacctcgtgatccgcctgcctcggcctcccaaagtgctgggattacaggcgtgagccactgcacctggcctaattttttgtatttttagtagagatggggttttgccatgttgcccaggctggtctggaactcctgacctcaagtcattcggcagcctcagtctcccaaagggctgggattacaggcacaagccactgtgcccggctgtaattttccattttaatcaaagctctgcaaattgaggaaggagcagaaagttctacagcgattaggtcaacctgattgtaaaactaaggaaggagcttgagttggccaagacttggtaaagatcttggttaggtaatacatgaaactaggattaaaatgctttcagggccagcacgatggctcacttctgtaatcccagcactttgggaggccgaggtgggcggatcacttgaggccaggagttcaagaccagcctggccaacatggtgagagtgcatttctactaaaaatacaaaaattagctgggcatggtggtgtgcgcctataattccagccactcgggaggctgaggcatgagaatcgcttaaacccaagaggcggaggttgcagtaagctgagatcacactactgcactccagcctgggcaatagagtgagattctgtctcaaaaataaaataaataaaaataaaatgcattctgattctagaatctatggtacctgccctcccagaattgatacagaaatttctttttttttttttttgagacggagtcgcccaggctggagtacagtggcaggagtgcagtggcgcgatctccgcttactgcaagctccgcctcatgggttcacgccattctcctgccttagcctcccgagtagctgggactacaggtgcccgccaccacgcccggctaatttttttgtatttttagtagagatggggtttcaccatgttagccaggatggtctctatctcctgaccttgtgatccgcccacctcggcctcccaaagtgctgggattacaggcatgagccaccgcgcccggccaatactgaaatttttttgttcttgacactttgactttcctgggcatagtgactgggctttattccaatcctacttgcatcaaaataaaatctgtgatcaaaattatcat

SEQ ID NO: 14381 - DNA, 254405 bp, Human
caggacgggcagattctagagggattctcaagaacttctcagtgacctgctagaatcaactctgcatattactttgaataagtttatcttgagatcatacctggcattttcaaagaatgtctaggggagcccaccctgtcgccccattcccagcactttgggtccttaagaaagcagagctgtgaatgagacagagggtctagttttaattccctatcatctcataatgaacctggtttggtttctcgttcctagatgggccacctcccttgaaaccaggaactttatctctcattccttctccatttggaggaccaccccctaaactggtagtgtagcatggggagacgggtgatgtgccatgcattttagtttgtcagttgccatgagaacagggaatcatggtgaatgggagagatcatagctattaggaccaagtagtgtgtctgttctggtttttattaaatttgttaattatctctttgtcctttttttgcagagagcacggataactttatcttgtgtaagtctgctttacctgttgctttgaaactgatttattctgatactatcggtaactattgaattcaaatagccctctctcctattccacatcatccctggcccatggcagctgagggcatctgagtgaactgtgaaagggaaatgaagggtagcaatgctttttaggcagttccaagcccacttttcttgggtaatcactctgtggttcactatcccccagggagttttctaatgtctgatgatgttgtggatctctttacctggataaagaggggctgtgtgaggatggacatgggtttcatgtgcctcaatagacccctattgatcatcttagttgttcttgcagagagaatatggaacctataaacctgctagtgtttctcacctgcttcaggagcctgagcacttggccaggactcgcctcatgagagcttgacttacaaggtttcctgataggctcatgtgtcctcagaaggaattattgaggctcagtttataagtgatttggggctagggctagacaatcctaaaagaatttggggttttgtttatggactgtagggaaacctgtgtttattcctttttcttttttttctccatgggaggtgggaataatagcagcaactgctgccatttttgcctcgtgtctggcttgagataataggtgctgtttagaaacaccctcggctttctggcactgatgtcaatatctgtgatttctttagttgtcttcagccttagaggacttgtaatcttgcagaatattccttcagagaattctgaattggggccatttcttgtcaaggaggtgattctagatggtggagtgaggggaaaattgatacttagcttcccatcctggccttgctgggtaaaggtggtgtttcccggtcagatggttctatttttttaacttaagctgcccttgtgttctgaaatcagtgttaggggaatggatagtgggctgattgatggatccccaggcctcctggatctcactgaggagtaaagaaggaaagagggagggcacaggaaaggcagggagaggaaaaggaatgcctgtggcaaggagtagcagaatgtcagcaacagctgccaccaccagtaacatttgcctaatccagaccctggccaggatcccaaaccatgtttctttttttctgttctatagctcatggcccaagttgcccaggttatgttattttctctggggttggggcagggaatgggactgaatgtcctttattcctatggagcctgtgcttgaactgtaacaccagccagatggtcagataggaacctggtctgtgggggtggggggtcctgcaaagcctggggaaggcagactgcaagagcctggctttcagaggatgttctgcagggggaagtctcaagggagcttgggagttgggcagggactgtggctgagcctccccagccgggaagctaactgtcctcctcctttttgtgtttggttttcagttgacgaagtgagtcccacacctcctatcactgtgacccacaaaccagaagaagacacttttggggtgagtcacttcttggtcaagaggagtgtgttgactggcatagtcattttcagacttcatttgtgttgctaacttttccaaatattatcttacttgaaactttgaaaaaaaaaagtaatgaattgaactacgttcaggcagtttaaaccttccttgttggatggaaatagttcattgtttgaggaaatgtttgacgatctgctccaagccctagggttcagaaaatccccagtctgttaggagcccagctgggcctgatttgcaggggctgctaactgtacaagtttcctacaaaaggccaagttgctcaaggcatctccttgggtgtgttttcaagcgcccactcctactatttcagagcctaagattactctggggaggaggagaaaggattctttttagaatccagatcttttcgactttcctggataagaatgttatataaggaattttaacatgaagatgcagaattcacttgctaattaaaacaaaatcagacgcctctctaggcttgtttttgcatctgttagaatggccccaggtgagaaggggctcagaacattgaatcgtggaactttctctaatcaaattgggtaatttatatacttttaaatgttctaagggtctcatatatttcttcttctaaagaccttactcagtattgcagttctgagaaggctacaattactatggcagtaggactgttcttatctgggcacacacattattttcaaggaaattgggttttctgtgattgttgctgactctctgtttctggttcctcacaggtatccatagcagttggacttgctgcttttgcctgtgtcctgttggtggttctcttcgtcatgatcaacaaatatggtcgacggtccaaatttggaatgaagggtaaggtgggagtttcattttcaagggcgtcatggggggaaacattactgcttttgatcaaaagatactgttttaatctcccattgctctctgagagggcctccggtcatggggtctaactggtactgatggaaactcctgtttgccgcttgttcttggtaattatggattgaaggcagtgttgggatctgtgggaaccaaactgtagatccacatggttttgctttgactgctgataaacattgcttagaagggcttatgcaatgaggataatttggaaaggaagttggatttcagggcaaatgaagacggactttggtttattttcattacgggtgagtaaagggactcctagtttgaggacacggttttcctcttgtttttgaagttgtgttgggaaggcgtcagcacagcaagatgtagggtagactccggcattgaaaagctgcccatgcaatgggatctcagcacgtagctctacacagagtcccagagtggatgccaagagcaacatgatttctaaatctgctggctggcttccatgacatacagtgctccactccactgtggcagggtggggtggtgggatatggctctttgccaaggctcgggtaaggggactggcatgaaaggggttaacatggtgaattagcatccacctgcctggtctcagagatggatgtgaccaaatggttcaagagaggctgggtaccagttccaaaacagaaacttgaatttcaagatatactcccagctggggtttccatgtttggcgatgttgggtgggggtgggtagggaggcatgatacgaggtttgataagttatcagtttgctgagccaggactcaggttggtgttatctggtgagactatgggatgtgtagagagatgaatttctatggattctctgcatgagcttgtgtctgtggttggggaccttggggcttagggactgaagaagagtacatgaatggcattcacagggacggtgatcctctgagttgtatgcaaatgttggagtgtttgcgcatggaaccgaactagtccatagctttcgctatattctcagaaacctctgtaactccttgaaaattcagaacactgatatatagggaaatacccagagaggattagaagggtagaaaaccctgtaaacccagctactcaggaggctgaggtgggaagattgattgagcacaggaggtcaaggctgcagtgagctgtcatcacaccactgcattccggtctgggcaacaaagaaagaccctgtctcaaaaacaaacaacaaacaaaaaatgggtacagggtgccctgtttccagaagatttctgcctttgcactctctgctcttgatgaacctgatcaactcacagcaaagcaagctagtttttcttaagtcatctgagatattttgaccaagagaaagacatgtgcaggcaaattataaaggtggatggaagtttggctggaatccagatgacttaaacaaaatcagaccacttttaggcacctagattggagatgtcttatctgcaaacacaacatgccaaacaaggctttctagatctagaagatgagacgaccactgagtgagcgcacagctttcaatctttggataattcttgggctcctggttttgaggactggcactattattgcctgtgcaaagttttcctaccatgcagggagcttttatagctcttcctccttccacctgagaaaacatcagggccttgaccaaagggaagaatggggcattgttgctcttcccctgaggaggcgcaccaccagctgagaccctgcgacatgcttggcagtgctgtaagagcagatttttcctattaattgtcatcctgtttctggaacagcatgtccccatgtcggatggattaggcagcacccagggtggttcctcccctcagctgtcctcagagcttctcccagcccctgctcccctctcccaggcagaccttcctttcttggccctggttgggtcaggagaacatgtccacgtaggtggaagtgaaatatcctctattgtaaagtcgggcaacttaaagtaagttatactggagttataggcaagatgagatggtgtatctaagactcaccttgtttagaattaagcctgaatctctttcatctttatgaagccagattatgtttgggtctcactttaggataaataagtgcaaaacaaaaataaaattctaagccccccaaccatccgaatgcatccctcttctcaacaagggcatcccaaagttaacctgaaaaactagttcagaccatgatgggaagcagggagccatacatgcctcattaaaccctccttctttttggaattactgatagaatagactcgttaagtctgatgagaaacatttgcaatctattctgtctgatgcctgctacctggaggcttcatctgcatcataaaaccttggtctccataacctcttattgaaccttcctattgaaaataactctttcaaccaattgccaatcagaaaatctttgaatatgcctatgacttggaagcccctgcttccagttgtcctgcctttctggtcggaactaatgtacatcttacatgtattgattgatgccttatgtctccctaaactgcataaaaccaagttgtggcccagccaccttaggcacatgttctaaggatctcctgagggctgtgtcacaggccattggtcactcatatttggctcggaataaatctcttcaattattttaccgagtttgactcttttctttgacataagcaaatgcctcaagctgcattaacctttgatcttttattgccagcgagcatcacagtcttggataaagagtgatgacaccggtaccagaagttccctaccttttacttagggaaagccttgtctcttcacatccaccccagtctcagttttgaattttcaagtctgggtgagaatgtacgataccacttaattgctcattggcttcagcaaagttactaccttctcagtgcctctgtttcctcaactccagaatggtaataatactacctccctcactgggttgctgtgagtgtcaagatctatgtgtaactggcatataaaaaggctccatgggaacatttctcccttcttttctttatgtataaaccttcataggttccttttattgccttccaaaaagggctgcccatccaagacgcaatcatgccctcttttgtcctgcacaatatttagtaaaatgcctttattatacgctaatcccagtacattgtcatttctttgctggtagaccatatgtctgtcctacttgaccaggagcgacctatggcagaaatcacagatcactcagcctagtatgcctgaaaacaccacgcaacatttgacaattgcttgttgaatttagaaatgaatgactttaattttaataataaaaaaagtacagcttataaattaacaatgggctagttagagttaattgggagatctgagatgtctgggcagtgggaagtagagagatgatgatagggaaaactcataaacaattccccatccacatctgagggccaggtgtatcgatagggagggcctactaataggagctttacttccttctgagaaataaaaaaaatacagaaaaagacaaagattaatataacaaacacccatattccctccacctagaataaatgacttactgttttgtcttatatttgcatttactgctttagtttgggaagatataaaatatgactaaaactaaaacccctttagtcatccccctggtcctattcccatccccatctccataggcagccactagcctaagttcagcatcctccagttcactgactgaagcttctttccctgtatctctgtctctgtgtgtctctgtcagctgtctctcccctcatggctgtctcccagataaactcacacctcccagactgccaaattagcaaccacctctactacatgaaagatgagtggctaaggctggtaaacagttcattttcatacttctacctatatgtatatgtacacatatatgcatatgtctctgtatatccatatgtagacacacagacatgcatatatatcagtatacttacaaaatgcattactctgtgagtgttttaatttatattcatgcttatactctgagtaacttgcatcttgctttatttccttgtcatatgttggagatctctctctgtcggtatgtgtaggaattccaatgggtgcccattttatgggagatgaatatattaaccagatctcctagaaacaaaccgaacatgctttgtctcagagccctccaactgccatgttgatcaaaattttggcttggggaaggggtcaccttgggacacaagctcatcttcttttggaatcacaaaggttttaagatggtgctaagtgtacagtgggggtttctttttgctattgatgaagtctaatgcttcagagtggcaggggtgatttgtgaagtatttggcatgtcctgggcactgccctatcagccagccctcctgctggagcagggccctggaggtccccactgtgctagacattaactctttgattgtcagatcatggggtggccagggtggttgggaggtgtgtacttgtggggttcagggcatgggctatttactgcagctacagaaacatataaaaatatttcagcattttaacaactaactagagtgtacccttgcatcctgggcctggaagtgagatggttcagaatttaggacaaattcattctcataaaatattgttaaattaggcattaaaagatcatgacagtgatctggctgggctctcctgtatccgtatttccaggtgaagaaaccgaggcccagacaaggaagtgacttgctttggtttggctgagttttagctccaacctctttccacagcaacacaaatgccctgactcctttgtcttggctgcacactgtccacatccatagtgcaccatcatcatttcacgtcgtcattagaacaataaccaggcaataggtgttagtgtgtctgaacaataataaaacttgctctgtagttttcatataaggtgagcatcaaaattatttaatagaaagtataaggtgagcatcataattatttaatagaaaaagaagcaagtgtgtggatcttttgcagtctgtaaaaaaaatacatacattatttggcctcttttcctcttgaccacctcataagtatctttaaatacttctagatcagagatactgtgagaattacttcatacttcttggcttcctcttactcccatgaagaaaacagaataatagtttatcagagctgaaacagaccttaggcttattaggctaatgtgcccattgtacagctaaggaaactgagacccagagagatgcagtgatgtgccagagcacacagctagcgagagccttctggccctgcttttccacatacttgacttgtgcagagaacctgggagggtcagggaaatgaagctggattatgaatacatcagctcaatccctccaaggctctgattaattaactttgaatgctgtgccacttaaatggggctttcgaaaattctcttattaatccactttttccaacctggggcactcctggccttggggaaagataggagctgatggaggagtaggctccaagaacttccttcatttattttcagacatgctagagactgcacgcgtggcaggacagcggaagtgggaaggccgggaaggaagggcatcaagaactgctgcttgggcttccggcaatgccttaagtgcctcatcagcaaccacttgcctttcttcctaatggctggatgtgtgctggtgcctctgatgggcctgcggatgagcacttgcaggactgttccattgtaaattagcgttagttaataggtacttaaagtaaagtggttgcctatttgattatgattgggggttattaacatttttttccataaacagatggtaactgtcctctgagtggattgtagaatcctgccagagtcttgatttggagggactggctcctgccaaaagatctcaggggctgctgccacattgaacattcttgttatccttctggtttcaccggttgtctaagggaatgattagagttgggaaggagtcatttctgccttctctcctaaccttggggcattggactgagaagggtttcttccaggtggagggaggtaggggtgggagggatctaggactcctgagttttgatgctgtaggttggcatttctttctcagctggaacagagtgtccctatgtcttagccatgtgtgcagagcaggggaattggtactggaagtgtggtgtgtgataggagatatccgaggtgactgaaagggggctgggaccatggatgaaagcactattggtattgttgagtaaaatagtttctttcaccctgcacaatacacttatttgactacatttagcagggggtcgggaaccaagagcagtgcaaggcggaaatgaaactgggtaaaggaattgggtttcctggcttcccaagatgtgtccattctttgctcctcctcgttttcttccttcttgacttctttttctatttcctcctctgaattgacatgtgcaagggaggagggtacctttggcccttgccatgatcctgtacttgggattcctggtgtaagatgactctttgaacataatgttgagagtggtttctggcttctttcctgtgttgtgatcccagggtcctcgtattctcctaacaaatgtttgcatgccctccctctcttttctgacatttgacagaccttccaaccaccccgcttcctcaaaaatgcctagtatttgacaaattctaaattaaagaggttaggtttgtagcagatccacaggcaggacataaatttatagaagccaggggtcttctgcgtctccttctctgctttgaacttcaatgggaggctctgactgcagacaaaggcccaccccacttgatgactgagttctagaatgtggtgcttggagctttgagaaggctgtaaagccatgtgtgtttttctggcatgcttttgctgccctgtcctttgtgggagctttgcaggggtgcagtgaatcatcatagaagtccctacacggtcaccattggtcgtgtggaggctgaacttgctctgaagactccagggaaccaactgttcccttgcatcgactctcctattcaaagggaattcccttgaaatagaggctgatgcaaaatatttttcctctgtggctacctgctagctggctcttcttggcaggcctctctatcctgttcagcagggccaaggatgaccactatgcttggctctatagccgaagtgatggcatctcagattcattgagtgttggcagcagagcacagtgcttactgactcgtgttgttgcaaatggctcccacagggttaacagccccgcgataccttacccagtttagacattctgcacctcttgtcccttgctactcatgtgacaggtgagatcacatgccttatgccctactgtggatgtcaccgggctttcccaaaagtgctggctctcacagtaattttacaccttaggaaactataacagaagatgagttagtaaatgagattttaaaagctaagaataatagtaaattcaaactgatttttggcttttaaaaagtcacaaactttagtaatttatttttcaccaaaaatcatggtgacatacttcctcactgatccagttatcctacagtatcatggtacaggatggaaaaccaagaggggctggggttgccagctttgactttctagcatccttctttgttccaaatgttttttaccccctgtaaagtcaagttgtggaaactgctccaacagaccccctcctctcttctcatggaacattctttctctctctgcatattctcctctgggtcttggaagctttcacttgcgcggaagaggcatgatgataggctttggctaatgagaagctgtcatgtggctgcagtacccaagacccgcgtttatgcagctcattctcctgtgaactctgcagagggctttaggatggccaaagagcagccctggaaaccaaagacagcaaaacagagagatcaaaacaactgctaaccagaaaacatgtttttggactagggaagaaaaaccacatgctgaaaacagcagccaccaagccaacggctgcaaatccccggccccagctccttgacacccactgccctttgtgctgtggttcctcatggaggataagctgggcaggggagtagagaggagtgcactgcaggtggaggaatagcatccttcagccagctgtgcttccagcaagcaggtgtgtctgccacctgttccagggaaggaagcagaagcctgaggctggtctatctctggcccttgcactcagaagggttaataacactccctgtctctcttcctcactatcccagcatacttagagagagaccaaccaagtaactctggtgcctgcttctttattgttttctcttggatgaactctgttaccacaagccagagggaaacatgctgctggcttcctccctaatgggatcggctacctaatttgtgtggcccagtgaaaaatgttcaaaaaagattagaatttccagacagctacagcacagcattaaatcccaagctaaggttcttttgagcacagagtcaggtcacaggtccacgaagctagctctgcttcctgaatacaaaatccatcatggcttaagatcctagctcctttgtctatcctgaatggtgatgaaacaggtatttctgtacttccttttagagagaagctgggatttgggcgaaagacaagaatatcagttggtttttcacttctaatcatagtaggggaagagagtgacaggcatcaaacattcattgagtacctactgtgtgccagacatctaatatatcttcaaatatagagacttcataggtggctattattcccactttaaagatgagaaaactgctcagaatggttaaatcactcaaggtcatgtacctggtaagtatcaaaactagattttaaatgagtttattctaaattgttggttctcaatcttagctgcacattctaaacatctgataagattatataacttcccaaacctaggccacactccaggtcacttaattcaggggtgggtgttcttttttacttcctctggtgatttctatgtgcagctaaggttgaggaacaatggtctcaatccaatagacgtccgcatatttcactggctctccaagtcatttatgtagtctgcagaccagctcatctgataatgctgggagcttgttcgatgtgcagttgcctagggtttaccccatacccactgaatcaaacttggggtgattggggtacaagcaatttctctgagtgatcctgaatgattgctggggtttaggaaccaccatcctatatctgtagagagacaatggctgataacatgaacggtacttctcaaacttgaacatgcaagtgaatattggaagattctggggatcttgttaaaaatgtggattctggttcaataggtctggggaaggctgcgagtcaacatttgttacaaggtcccagacaatgctgctctgtggaccatgctttaagtaataaggggtaaagttactggtaaatacttcaggcctgcgacctgggaacttagatcacctctctgctttttgttttttcctgagtgccagttgcaaaatgaacctacctcaaaggtctataggctgggattttgtgactataagattacaaactataaccaccatttttttttttttaaatttttgtacttttagtagatacggggtttcaccatgttggccaggctgatctcgaactcctgacctgaggtgatgcacccatctgggcctcccaaagtgctgggattataggcatgagccaccacaccgggcctctataaccactacttgtaaggcatttcagttctatcctctttgggtaaatatgcctctcttctttcctaaaactgtttctatagtggcttccttggttcgaaaccaaactgccacctctttccacatgacgggacttgtaaggtctgctgccccagttgatttcagtaaactgtcaggtcaatcaacactgttgcccccactgaaggagtctgggcagaagctcagagaggctagcaggcagtgggtagccagcattcccagctcagagctccttgagctgctgtgacagtcattcctctctttccttagaaacttctttatcctgtttgctctccctcccacccctgatctggaatgaaatgttgagggctataaaaaaccggaaaagcttgtgctggcaggccccggagtggctcggagtgggtctgtcggtgggcggaggaagccccatgggttaagttggtgggctgcccgggctgcccgccggcctcagagacactgccctaggtggtggctggaatcccattcttcccagtcttgctgctctggcggttggtattcacactgaaagcctgccctgccctccaatttactgcagaataagagttgcatagttggcagaagaccagagcagtttccaggactgataagtcctggaaatgccgagcctctctacctgacaggcatcttgaattcaaaggggcctctgtgctggagcagccctgcaaacctgttcccaggcaggggcagaagaatgccagcatctgtctatctgccagcaggccttgacatgaagccccaaggagggcgtccgggtggttccaggaactgcctttcaaaagtgaatccttccaaataaatggagttcagtgggttagccttggaccagttgaaggaggtgcagaggggcaccctgttgttggcctgggctctaggggaagcaggcaggatttgagtactgttatgagccattatgtgtgaaaatggctgccatagcaccagcccgctgctttgtgcctgctttgcaaggggcatgccaacctgagggagctgtgtgtgctgcttgctgccttctgaggagaagcgctatcagaaatcaggggccatccaagagcttgggaaaatggacactgtttgctgttgcccagtgtgtagaatggggtagcctttctggaaagtggcttgacaatatttattaaaaacctaaaatcacaaaagcccatgcctactgactccacttctgagaatttaacctaaggtaatactcacaaatggctatctgtatttgtggatatgggtatttatcccagtgtgacttacagagtaaacttgataaataaataattacttacagatctaacaataaatgactagttaaatattaatacattatggtccatatatatgataaatacaatgcagaccttaaaaatgacaacttttaaaagtaggtatttaatgtttctgaaaggatacatatgcaaatggtaagaaaacctaatagtataaaagataatggagtaaaaatgttagtttcagtcccttcctaatttcctgccactgggataaccattacttagaggttcttgcatatcctttcagagatagtcaaggcttatgcaaggatatgtttccctgttgcctttgcacaaatgcaagcttgtattcacattgttctgtgccacattatttctgctaacagcctgtctttgagatgagttagtatcagttcatagagatctactgcattctatttttatagttgcataccaagaatgatattttagcaatatgtattgacatgtgaacatgtttacaatatatttccaagtgagaaaagactccaagcagtttctctaatgccatttttttttgttgttgtaaaataaagagaaaatatttttatacacatacctaggaaaaatactaggatcatatggaattataagtcagaatgtaaacagtagttatctttgggtggtgggatttgggatttttttaatttcatcttttttgatgtcttctgaggtttctgtattgaaccttaaaaacaaagcaaagcagatgtgagacccatgaggacaggggagctgttcctccctcagtggatccagaggctgactcattcccccacccaggatccatctgcccctttgtggtgaaagccacggctctggtgtcacttaggattgctgactgcacagagcaggattcccataatgttgcctcatgccacatgcttgacagtcattgatggtggtgtgtgtgtgtggttgttgttggtggtggggggggtactgattaaagtgcagattcctgggtcacatctactgaatctcataccttgatagtaggccctgggaatttgcattcttaaaaaacaggctgggtggtcatactgccattaaagtttgagaaactattgtgtagatcaggaatttgccaactttttcataaaagagcagagagtaaatattttagactttgctggccatatggtttctgttgcaatcactcaaggctgctgttgtagcatgaaaacaatcatagccaatatgtaaatgaatgagcatggctgtgttccaataaaactttatttataaaaaacaggtgccaggccagatttggcctgcaggccatagtttcagaccccatagtttcatgttacccttaaaaaaaaagttagaccagctgtggtggctcatgcctataatcccagcactttgggaggctgaggcggctggatcacctgaggtcaagagtttgagaccagcctggccaacatggcgaaactccatctctactaaaaatataaaaattagccgggcgtggtcgtgtgcacctttaatcccagctactcaggaggctgaggcaggagaatcacttgaacccaggaggcagaggttgcagtgagccaagatcacgccactgcactccagcctgggcaatggagtgagactctgtctcaaaaaaaaaaaaaaaaaaaaaagaaattgatcagcaggtgggggagtctaccaagagctccttctatttgaagaagcaggtcataatattaatagctacaattaattaagtgattattataagcctggcagtttccagacaaaacctacaccttaatacagccctgcatagtagctataccaacaaggccattgaaagaacaaagtgattagcccaagcttacatgatcagtaatgactgggttggtctgaatgcagacttggggaagaaagcggtaatgccacagttctgttactttctggtctttgggaaagaatgatttcaaaatctcttcccagggcatcgggcacacacaggtccctctaagcccccagcctaaggaggaatagccacagccacgcacttggtggtggtgcagatcctggggtaactctgtacctcccggatgcctcgaataattggggttgtgagtggtgtggggtcttccaggtgcattggacaatgctcaggttgatgtggctccgttcactttcttgaagcgggggagagtgctgttgctatagaaatagctcaggtcactgtgctggacctttctgaaccctgctgctcagagtctcccatcactgggaccaagagcccttagagccaggctcctgacaggagacttttttgtgtccctgctccagtgaccatgcaagtttccacatggccagtgttaaacattcaccctgcttaaagcccatggagataggttagtgccctacttgtctgcagacagggctggccaagagagactggcagtggcaggcagaaggcagtccctcgcttccttctgtcttctccccaccccagccttcctgaccttcaaccacatcccgactctagggcaaagaaaaaccctctgggctgaattcagcctctggggctcatggttcagcttgatggctttgccaggtagcaacatgggtgatgctagtcccctgtgaggtaactgttataaagatactagtgttttacatttatagacagcccagtttgccttgacatgttggtttattacataaaatcttgaaggcttgggctgctcattggattaactgaaataatggacataaaacagaaaccagaggctgagcatggtggctcacgcctgtaatcctagcactttgggaggccaaggcgggcggatcacgaggtcaggagatcaagaccatcctggctaacattgtgaaaccctgtctctactaaaaatacaaaaaattagctgggcgtggtggcgggtgcctgtagtcccagctactcaggaggctgaggcaggagaatggcgtgtaccttggaggcggagcttgcagtgagccgagatcgtgccactgcactccagcctgggtgacagagtgagactctgtctgtctcaaaaaaaaaaaacaaaaacaaaaaaaaaaccagaaaccagaacttggaatccagaacccagaacacactgctcaaccaaatagtagcaaattgtatcattgttaccatccatattatgacaatcagtagtccacacagcagcccctttaaatcgatattatcattctgtttttcacacatgagaaaactgagattcacagaccctgctagagttctaaggagggtcacaggtttgtctggcttccaagccacatgctcttagtcactatcatacattttaaagtcagaatataaggagacctagggctgctgggaaccttagggagtccccatcccagggacctgcagaaagcccttgacagattattcttcagttccctcaatcacctgagagcctcctgccttcccacaaaccagtgagtgtcaaactccctaagctaacagcttcatactgtcctcttatcagttaataagctgcttacccagcctcaggtggacatttggctgcgggttaatggggccttttttggccctggtcctggccctttaatccactctcccacccctttctgctgtctttctctctctccaaggatgcaagtattagtacttcgggaaacaacataacacctcctggtagaaacctcaattccatattgcacctgaggtcgtgactagccacttgccttggaaggaccctatccaggttcaaggaggcagcttaggcaggtgtgaagcagcagcctggatagatgcctcagccattgagccccaaaccatgcccggggtgaacccccaccccatcgctcatcatctgtatctcagtgaatttcctgtaaactagagacataggagtcattcttgacatgtcttcttgcccagtccccatctctttacccctccatgctcttgcacagcccagtcttgtctttgtgacctaaatatctcctgaagttgtcccttctctctttgcacactgccaccccaccattccatctgggctcctcccacatggctctggacctggccccttcagtgtgtgccctgctctgtaatcacagtagcagactcaggactttgaaatgaaaattgggttctgtagtagactcctggttctgaaatgaaaattgggcccaggagtctagctcctgccatgtccccagtctcaccgagctatagggtttccactcttgccagccttgttccatgctccctaagactgaggttcctcatgcaccttccctctgtagcactttgcacagttattgacaggaacatttgattagtgctttgcctctccaagtagactgttgtgtttgctcactgcagtaccactcatgtcagcagaccacttaaggcatagggtgcataaatgtcctctgggccccttgggcattgcacccaaagggctggacctggagctcctcctctgaccacccctagttttgttactactgtggtgaagatataatctgggatctttccttttggtacctgtggattgcctgtaagatggaggcagggatattctgggggagaatgttctcctccatccaacagctcttgccttgcatttcttccttctgcctaccccacggtgcctgcagacaggaagacgctaggtctgacctgccttttcctaagatcccacctccatgtttacctgatcttctttcttccttattgtctctttctttacccaccactttgtgcagtatctggccaatgctatggcttcttttccatgccatgacactaagatttcttccccagtcatcctactggggctcattaaaatttagagctatacaggctgaggtcgaatctcagttctgctgcttgggagctgtgggacttcaggtgacttatggaccattctgggcctccacaccctcagctgacaaatgagagggataattcttatcatacagggttttatgagaattaaatgaaattgtgtatataaagcaattagcttagtccccagctgtgtagtaatcactcagttaatgtgttgaggggagaaatcatgatttttgctgcactcagaaaagctgtgagtaatctgcaggtcccattatggctgtggttcatacacttggttttatggtagaatcgcatggggatctttaaaaaatttcaacagctaggctactcccccagccagtgggtcagaatctcagtggatgggctcttggtgttggttgtttctatagctgctcaggtgattttcagtgggaagctaaggctgtcagcctgggctttcccaacgccccccgcccagccccccacctctttctgccagagcacatatcttggaactttaaaggaataggagggatgcgggctgaaaacatggcgggaaaagctctctttattgggctcccacgacgtctctggcactgtgcttggtgcttcactttcatgtttccatttgattttcactgtgacttgtgatacaaaaattattgtccctgcttcttttaggagcttcaggaaggacgagctccttgcttaatgtcaggtattaggtggcttaaggatgaaggaccacgattcgaggttggtgaggttggggtgaggacgctgtcccctcttctctccctcctgcagagtgctcctttggtgaggtgactgaacgccccaattttccccaccctctgcgtgaggcctggctactgcacctgtccactgcagtatttaatgacccagcctgcttgcggctcaccgggccctcgccagtgatctgccacctgttctaccttgcgcggtggtgctgtttgcttaacggggaaatttaagtgccttgcaaagactccccatggattgggggagaagcatccgctgactagaaatgggagcattgttgttgttttgttattgccataaatttccaggcactctgttgggttggaaaatagtgaggggtggatgggcagagagagggagggattctttcttgtctgactgtgcaagtggattagagagagaattctctccttcatagctcctcgaactttatggtgcacgtggagccctggggatcttgttatgatgcagattctggtttgataggtctggggtagggcctgaggttctgcatttctgccaagctccttatatgaggctggtcctattggtctgctagccacacttggcttagcaaagctatagcttccaagtgagggagactcaagtctgttttttggcccctgcaatttttattttggaaagtgtcatggaatgttatagaaatctggattctagcccaggctacactctgatttatctttggatatcttttgagctttacttttatcctctataattggagggatttggattaagggcttccaaggtccctttcagttgtaacattctatgattctgtcagttggagagggtagatcacagggagcatggagtgaggaggatgggaactagtgggaggtgggagttgtcaggagcacccattgcatatatgggctattctttttaggatcaccaggtttgaatcctgagaggccagaagtgaggaaaataggcaatgaacttccttttgtgctgtgtgtccaagatcccagcgtagactatgaactccgggcaggtagtgacagtgactcttacttcctgactcacatacttggcttctccaaatggcaggagtgtatttggggatgttagccattctgtgggtttcatggagggtaggcactgtgggacacagatacaagcaaggcacacttttcatccttggtgagcacagtgttttcttaagagaatggcatatctttcagaacctggagtcttgctgttactttcagattggaattgctcttcctgatactgtgtgtccagcaactggggtctttgcctatgggctactgtcagcgtctcctgatgtcctgactgttggttctgggtctgcccctacctgcccaacagtgtatctctaggatgtcgcttgctctccaccttggggtcctctacttgcctgccattgggatatctctgctttctgcccctctcccgcttgttggtctcttggatgcccaggtagtgaccacttccagtttggctctcccactgctgactgggacttagtgatgatagtacattctatttggtgggttcaggtctgagatcgtgtgatatttttatgttgctattccctgcagaggatttcacacacaggcaggctttatccattcttcccaattagacacatctgtgtgcaaatggataggccttgggctcctgtctctcactgctcttgagagaccaggaatgggccacaattgggccagggagggctttcagaacagggagcctgtgaagtttggagacagagtcctggtgtggatgggggtgctaccatgacctcttcagttcttctagaccaacagaagctcttgaaactgtgcattgagcctaggaagggacatgcctttattttgcacttcatagattttctttttgagacgtggtttcactctgtcacccaggctggagtgcagtaatgtgatcacagctctttgtagcctccaactcctgggctcaagtgatcctctcactttagtctcctgagtagctgggactacaggcacatgctgccctgcctggctaatttttgtagtttttgtagagacagggttttgccatgttgcccagcctggtcctgaactcctgagctcaaacgatctgctcacctcagcctcccaaagagctgggattacacatgtgagcactgcacctggcctgtggacttatttttataaaaggaatatatattcattatataaaaatctagaaaatattgtataaaaaattagtggtaatcttattattcagaaatgaccactgttagcatcatatgtgtgaatacatatatgtaaatgtatatatgtacatatgcacatatatctatgtaactgtagatctgtacctgagtatctatattcccatacttttttttttttttactttttgagacagagtcttgctctgtctcccaggttggagtgcagtggtgcgatctcagctcactgcaacctccacctcccaggttcaagcgattctcctgcctcagcctcctgaatagctgggattacaggcacccaccaccatgcccagctaattgttttgtatttttagtagagacagggtttcaccatgttggtcaggctggtctcgaactcctgacctcatgatccgttcccccttggcctcccaaagtgctgggattacaggcatgagccacatgcctggcccattctcatacatattttaaatgtacacttaagtgaaaatggtcttgagcaattcaaacagtgtttgacctatttttttcacacaacactctttcttaagcatccttccgtgtcattcagtaaccctgtctctagcttttccattactctgcaaagctcattttcctttcttacattctttcttttcacgttgcttgtgtattataccatttcacttggttaattcagaatctaatccatttgccccaaggctgcatggcaaaagggcaaagtatgcatttataaaatgtgaatgagcataaggaagacacaggccagggttgctcagctccttggcccagtaaagctccctctgtgcatgttttcagctcggctttgttcagggagcctctggtaggggaacttggcagaagccaagccaaccttgtcctgccggccgctgtagcagccgctgcatccattagcaattatgggtcatccactgtggggcatttcagaggcctgagggacacagctttgccatgagcagaaaccactgggtaagccggaatggaccaatgaaaatatgtaatcttgacaacagaatccttgaacatacgcacacatacacacctacaaatgctcacagagtgcaatggaggcagcggaaagcagtgactacgggtgaacactctgggctaagactggaattggagtcctagacttgagactttctttttgatttgggtgagtcacttaaactttctgaacttctgctgtcctcatctgtaaacgtgaatggtgctcacgtgagaaggtattgagagatttgactgggattacatatggaaagcatttggcacagggactccacgtggtccatgctcaggaagtggccaccactggcttagttttagggatctcagaggtgggggaaaggcagtgcttctggtgtgggggtgtgtgtgtgtgtgtatttccactcatgaggtacctttcctttgatgaacatataatactttatggagttgtttttatttaatgtctgtgtgaagcacaaggaaaagatatagccctgctggtaaatccagacccagagaagcagcgtatgtggaactagtggagcgtgtactacaccaatagtagggagatgcagttcttctcctgcctctgggactgcatggctgtgtggccttagctagtcacttgttctttctgatcctctcttctcattacttggaataagccagctgattggaacacctcattgctaaggtctcttctaaccccaaccatccatgactctttaaggtagcagtggctaggtccttgggccttccttgaatgttcccctaaatctggagagtcatctctgacacgttaaatgtagacagtcaggccaatactctccagcacctaggagagctgcagatggtgcctggaattggcaacgttaagaataagctggggacgaggagccgtggttgacaatcaggtccatggcctcactgggttgtgctttctctctctaggtgtagtttagtttgaattatttatgatgatactttctagtcatttgggaagatgaatgaagtctcagtaatcagagcccatgcacagcctctcttaactaaagtgaattgagacatcaatccatgaagagggtcaggactagagaatttcagggcttgcccccaggatgagccacagccagcagagtctcatcaagcaaagggacagcccaactcgcagaagcagagtaagggtgctctgtcttctaaacataaaaggacagggcagtagagaattaactccttgactctggcctcttagcccttgcaggtgtataacttgtcccctctgttctcctttccatctccctgctgatgccaatgagatgtttaggaatgccttctcctcactgcccctgaagtcatagtttccttgagctcagcacacaggattggcagtaggaagagacaagagagcatgaagatgtgatggctcaggctgcagaaaggactgggagagggcagacagccaggaaggggcagacacacacacaatttgaagtaactgaacttcagtgctgatagctgggaagtgccaccatcatgaggctgtcaagggcaactcactgaaagtcaaaacattgtgctgatgacagagtgagaagccagcagctgtaatctttagcctcgtgaaagactgttaaggaagcccacacagcaaggaaaaagtggccaaacattttcaagacatgagctcaggttacagtcggaaagataaacgttgttctaaggaaatgtgcatcttcattagagacagtagaatggatttcaaaaggaagctgataaatgtattttactttaaaactataatctacccgtgtccaaactggaaggaatctcatgcaacagttctagacatacctgcatgcagtgaaaagtcgtcatctttcaacgtcaaaggtggatgtgtccctgacgtctcatccaccttgtcatattgaaaccagtaacttagtgttatttgtagtaaaatattctataaagtggtattctctgacccaggatcagctctgcttttggaggcaaagcagatgtcttcttccagatgcctggctatttgggggaagaggaggtcccttatagcaagaatgctagactcaaaaggaagtttagtagcacagaaaacctaagtcagtggccagttatacagaagaatgtctctagtgtagaattgtccattggcatcccatggaatggattcctggttgtgctgctccagccacaacctctaggatatatctagagtctcctattgccctttggctctcaaaatgtaaggagcttgttatctctggttcaggtggggactctgtgggggaatgggaggctattggaggggtttccatatgccttaacccctcgctttcatgtggggatggcttatagcatggcactgaagaactgtgccctttcaaggtcactgtcttctatgaatcccctcccagagtcttactgagagtggatgactaccacgggtagatgggattttgatccaaagaaggaaagaagtttatatgtttgaacaatctaaggtcttttttgactgttaaacctatgggcagtattgaagctgccccatctttcgccactctggtgaatcagaaaaaatcatgttcttctctgcctctctcataccaatcagatatctgtccgtcgttgtgtgtgtgtgatttattttaaggaattggctcaagcagtagtgaagcctggcaagtttgaaatctgtaggacaggctggcattctgggaactcaggcaggagttgatattgtggtcttgaggcaggatttcttctctgggatgcctcagtttttgttcttaagaccttcaagtgattggatgaggcccatttatattatcaaggtaatctttacttaaaaccaactgattgtgggtactaatcacatgtataaaataccttcacaaggacacctagattagggtttaggaaataagtcctaccatctagccaagttgacacataaaactaaccatccttgcctaacctccttgagcctacgttcgtcatgcataaaatggagttataatatctgtaacacaggttattgtaaggattaatgtattgacatccatgtagttcttattctgtgcccagtaggtactttctattaggctgtttttcgtattactaccaaaggctgtgagtcatatggcagggaccatcaaaacgccttcatcaactctgactggagggtggttatacctttgtgcaacaggccttttgagctaatagagacaggccttgaagggtggtcggattctggaaggtgatcctcttggtagagttggagcatttcttagttgattagaggatgctaattgaaattcagctatggtagaatcttcttggggagatttcggagggggatggcacattcttttgggaatcttcaagccaattcttccttccctgtgtctttttttaattatcatggatatataatagttgtacatacttatggggtacatgtgaaattttgatacaagcacgtaatatgtaataatcaaatcagggtaactgggatatccatcgactcaaccatttatcatttctttgtgttaggaacattccagttccactcttttagtgattttgaaacaggtaataaattattgttaactgtagacatcctattgtgtctactgaacactaggtcttattccttctatgtttttgcacacattaaccattcctgcaagtttctttttcttttgtcctttccaggtggcctaagtatagaaagattgtgtttttttggtataactaaatataccaaaaatatgcttaattcaaatctagcaattcatgaagaattagaagcaccttctagaatgcctcttatgctggggacatcatcaagaaccatctcttgcttcttctgtcagcatcttcttcctgtaccatctataatgctgttgcataggaccaggggagatgctggcctgaagcaggggcagaggtcactgtggttctgggcaggtccttgtggttctggtggttggggataccccatttccgcttcctcttttcagcctattttatttttttattttattttattattattatactttaagttttagggtacatgtgtacaacgtgcaggtttgttacatatgtatacatgtgccatttggtgtgctgcacccattaactcgtcatttagcattaggtaaatcttctaatgctatccttccccactccccccaccccacaacagtccctggtgtgtgatgttcccttcctgtgtccatgtgttctcattgttcaattcccacctatgagtgagaacatgtggtgtttggttttttgtccttgtgatagtttgctgagaatgatggtttccagtttcatccatgttcctacaaaggacacgaactcatcattttttatggctgcatagtattccatgatgtatatgtgccacattttcttaatccagtctatcattgttggacatttgggttggttgcaagtctttgctattgtgaatagtgccgcgataaacatacgagtgcatgtgtctttatagcagcatgatttataatcctttgggtatatacccagtaatgggatggctgggtcaaatggtatttctagttctagattcctgaggaatcgccacactgacttccacaatggttgaactagtttacagtcccaccaacagtgtaaaagtgttcctatttctccacatcctttccagcacctgttgtttcctgactttttaatgatcaccattctaactggtgtgagatggcatctcattgtggttttgatttgcatttctctgatggccagtgatgatgagcattttttcatgtgtcttttggttgcataaatgtcttcttttgagaagtgtctattcatatccttcgcccactttttgatggggttgtttgtttttttcttgtaaatttgtttgagttcattatagattctggatattagccctttgtcagatgagtagattgcaaaaattttctcccattctgtaagttgcctgttcactctgatggtagtttcttttgctgtgcagcagctctttagtttaattagatcccatttgtcaattttggcttttgttgcaattgcttttggtgttttagacatgaagtccttgcccgtgcctatgtcctgactggtattgcctaggtttttttctagggttttaatggttttaggtctaacatttaagtctttaatccaacttgaattaatttttgtataaggtgtaaggaagggatccagtttcagctttctacatatggctagccagttttcccagcaccatttattaaatagggaatcgtttccccatttcttgtttttgtcaggtttgtcaaagatcagatttttaaggtaggaggagtttataatttgatgggacagagccccaggcattcactcagagggtcatgttttcaagtgggcaggtttcctttgcctgaaaggtcagtacccatgcagtatactttttcttatgcccttcttctgtgacatcctggctgcatgtctctttttgttctctgcactgctgtctgctatcaggtgggtaaattagctgaggcttgcttgaattcacagaagatggaatggtaaactctgtttccgccatctgaggtttaccagctcactactgggagttgctggctgccagctcagttgttaactatgtaatacttggttccccccagccagtattttctgcatatggctctccagatgggagccctgtggagaacaggggtgttgggaggatcagtccttttggctgtttggttataacacacttgtaatagcaccgaagcctcttgcattgttctttggagcagagcttgattctcattttgcttctttgctgtgtgtgtctccctttcacaacagaatcttaggaaagcttatatctgaaaggtggccagcactggggccagcacatgggggttttagggaacacaggagtgaggagtgagcttcaaggaatttgatggggaaacctttatcctcatcactggaagagtaattcaagcttaattaaacaagcttaaacaatctgtagtttaagctttgtctgtccattgctgcccttggagttaacttttaaccgtagagtcctcaaaaggccagagaaggtgcaaagtatccttgtcaactccatgtccccctccccaaatcctgaagccttttcagtagatgtgtgtggggctagtccatgctgtcggttatctctaactatgtgaaccgccccaccatagcgttcaatttccagttttaatgtttgttttttgttcatgtgagcacttagtaactattaagtcaatgtggtcatagaataaaagacagttgcttttaagtttcccccacccctgcttttggatgcagaattggagactcagagagatcaagtgacttctctgaggacagttttgattgtggcagacccggctagcacccaggctcttagctcccgatgccatgttcctactgctgtggcattttgcacttttatggacttaagttctagcctctttgtttcatgaatcattaagagtttcagggaatacctggccaactaagggatgagatcagtcagtaaaatgaaggatctaaattttgaatccatgttcctgttcataatacacgtctttgcagtcatttccccttgtccagcctctcttgatgagagacttttttagcttttagcaggtactgtagccaaagcaccttctctcttccatgttccttctccaaatcatcttttttcttttcatcagctggaccatgttttccttttcccttccaaagtcagtcgtgctccacattttgacggctttccctggttctgtgaattccttccaagttgctgccatctttctactaataagctgcccaatacactgtaccggtcacctccctggagcctctcacagcctcctggatgatcttcagcctctattctggaaaaaccaaggcttacacaccacccactacaatgctctttcagccctgtgctctccaggtggccttggctgttacatcttgtcgttcatcacccctaccacctttgcaagattaaggtgaggtatatgagcccttcgctttgggcaaaaaatttaagagggtgccacaaattaaaaaccccagtaatcaagacttttttaaacctacagattttttgcattaattttgttttcatagcatatcacattacagtattatctctcttgattactgagtttctgagcagctcccttgattttgggcccaagatgaatgcctgtctttcacactccatctctcccatgttcctttcctcttggttttgctcctccccatccttttctgtaattcctctagtcttctggcccctgcggatttattccttgtgaattaatgttctgtttacatcttcttccagattgttaataaagatgttaacacgttctctaggcctcactccaacctcgccatagctggcccgctatctggggccctctgctcaagaaaagaaactgcattttatcataagttctgttgtttaccgtctcctggtgagtatttccatcccacccaggttgctgttatccttgtccaagcgccttaatgtctcatgcgcgaggcttgctgaagctccacgagtggcttgaaagataagcccttgtaaataaagcttatgatccttgttaatgttgggagctgatggcatgcgtagtccagccaatttggattaattttccaagggagattttggtagatgctacgtcaacagattctctgaaatcccactctctcaccttgcctcccttttccttggccactcgctcgtttttgccaattaagaaaagatatcacttccgtggtggggtgtgatttactctttataaaccccggttgctcttccgtgctcaaagtccacttgctgcttataaacagtgcttttcctattggccttatcctttcagtagcagcttgaactagatttacctttgtttctttttgtcagaggaaaagatagatttttataacataaatttggcaaaatggaaggacactgtagaataaaacatcctttgcaaaaagtacacacttttagcagttcacattttttaaagaagatagtcgttttcttggttctctgttaccgaagtagcaaatgtccatgaaactaacttgggaaatagagaaaaacagtaaatcacccttgtgctagcaccccaaaataaacactgtttacatcttggcacctttccttctagtccttgttacatatttatcatgctgtagatgcaattttgtgtctttactttcacatagtatatcataaatagtctccatattattatgtaatcattataaccatcgtttttaaagattgcgtgcttttcaatccaagtaaatctgtctttttaaatttaatcattccccgtttattggtcacttaagttacaaatactattatcagtaacaatgaggtgaacatctttgtatgtatgttttccttagttaggattatcctataccttagattcctggtggtggaattactatattaagcgtgaggataaacatgttgctaaagtgtgttagagaagagtttgaccaatcaacaaagcctctatcagtgtatgagactatctcttcccattcctcttcttgtactgtgtaaaaatagttcttatcagtgcgttcctgtcactctaggagttactcaggtagacatatacataatcacactcttcatagtcctctggtacatttgtcatgctaacagcattaatgatagtagcaataatatcccaactgttctctgacacacctctttaaccagcactgttcaatagaaatatattccagccaaggatgtaacgttaaattttctagtagacatgttaataataaaaagacataggtgaaattgattgtaatactatattttatttagcccaatatatcagagatgctatcatgtcagcctgtgtcactagccaagtctcaggtgctcagtggccacatgtggttagtgaccactgttgtggatagcacagctttgagccataagcctaaagcactaccagactctcttcttttgtttagaaaggctgtcaaatccttctttgcttttcaatcttagttttggttctccaaaagtcaactctgagataaggacttgatgtgcaggtaatttatttgggaggtgattccaggatgcattagggagcaagcgggcaatatgaaagggagatgataaagtcaagaaagagcgtgacagtgagtggattgctgcagtgggtaactggagcttagtcctgctggggaccgtctgagaaactgggtggcacctgcctcaaagttgctctccactgcagatgcagggactggaacatgtatttagtgactcctgtcctccattaattagttatgggttgttccagtggtattaattaccccacacttctgggttgtacctgcttaaggccaagcttgctcttactgtgctggagaaagtccttaggcaaagaaaaaggatgcaggctcttgaggtgggtgtagtttgggggctgaactgcctgctgtctttgccaggagactcaggtgggccagggatatgagtggggcctcagcagcacctgcctctgggcctgtgtcatggtgaagtagggtcttctccagtggggcttttcccaaccaggtcatccttggttgatagtcatcgtgggtgattcagtccatattcttttatataagccacagaaactgattctggctaaccaggcaaaatgtaaatgatggagggatgctgggggctctctggatgtaataaggcctggaggagagggctggtcaggattggggatgggagagaataagattttgtcccatgctggaataaactggcaggacagttagcatctcggagaacagcatgattaggatgccctgtgttccctccctctgtttgttctggggaaggaaatggggagcaaagtcactttggcttccttttagaggtcaccacctaaaattattttcccatttatactacacacaatagaagaaagataattccttgatagaaaatcaaatcgctgttagggaatgaatgctgggctgctaaaaatggacaaatgaccactgcagaaggagattgggctttctggtgaaatctgagtaaaattgggctgatttcctggttttgataatgtgttatggttatgtaagatgttaccactcagataagctggggcataggtacatgggacctttctgtactatttttgcaacttcttgtggctgtataatcatttcaattggagtatccaagcttcacctttacgccctacctcatcctccaaattactggtgctcaatctttagacctaaaggtactcctcaaaccttctaaacctggggagggttatgcacctatttatttggattcaactggttttcttgctctggttaatttattatattttttggagtttatatttgcagatttgatgttgacctgcagttaattgtggaggatagcaagcaggtctgaaagtggactgagagttatacaaaccctgctttcctccttctgactccaagcaggtttcccaaaaatgccattgacaacattgacaccctgtaagtgagccatggttcaatggagaccactcatcgctgatcagccccagaaactctaggaagggttgggtcatccagttcagaaagctttggctcagtcctttgatttctgcaatgtacttggtcagatatatctcttggtgagaatagagtgggctaaagccatctttgttgagacattttctccaaatagcagccatttctttatgtggctttccaaccagggcatattctgagaagactattaaattctcacatgggaccattgacttgaaggcagtcaacccctagagaacacaagctgttctcactcttccttcttgcagtgattgaatgtcattgctgccaaggcagagtctgggctcacgatcacaggtgttgtggtgtccgccagagtgccatcaatttggccatagccacagctcccaggtaatgggtattggaagccattgcttgtctaaacaagatctgtgagacttccatcctcagttagctgttcaatttctactaataattctctaataaacatttggccaatcagattcagtctgttacgatggagttaaaacagcttaatttaagcaataataataattgacagcaacaggaaacactgagccatattcttcccactgtctaagtcattccctgggagtaaatcaagtgtttaaggagggacattcacgtctgcagggcactggggccttgctcagtcagctagggctgtagacatcagatggtccccaggccatggcttgcaaatctgtgcatggcccagccctaggagaaagcccaggctcacattctacatgtcatccttcttcccaagaaggctgagtatttcatgagtttcatgagtatgatctcattcttccttctcagctgtctctggagggtgggaggggtctgctttggggacgctgctggcagacttctttttattctttttttttttttttttttttttttttgagacggagtctcgctctgtcgcccagtcgggactgcggactgcagtggcgcaatctcggctcactgcaagctccgcttcccgggttcacgccattctcctgcctcagcctcctgagtagctgggactacaggcgcccgccaccgcgcccggctaatttttttttgtatttttagtagagatggggtttcaccttgttagccaggatggtctcgatctcctgacctcatgatccacccgcctcagcctcccaaagtgctgggattacaggcgtgagccaccgcgcccggccgacttctttttattcttaagccccttcctgcagcccacttcttccaaaggctgcagcaagaagagccccttccactggctttttaaagacttgccaaggagccacacagtgtgcttggggaggagtgagagtgcatcccctgtttgtattatgggatttggaattagggagggtttaggtcaaatcctggcaccaccacacaggtgaccttgctgaggctgtttgccctccccaagcctcagtttcccataggattggggaaggcaataccacctcgtgctgttgagacagtcaataattgataacaacatgtacaagataagtagaaagctaatatgattaatattaactttatagcaacccccccgcttgaggcccacagagagtgttacaacccctgcttgaggcccacagagagtgttaaaggaatccttactgagtccaaagaaagaaccctgtcttctggtccatagtgctcatggcagattatgcccatgctgttgggtttgcactgctgattcagggatcagaccacatgttcttcataacaatgatcaggtgcatcattggagacaggtatgctatggcagaaataacatgactttgagatgaagacagagcctgtctatttaaatcctgactgccatttatgagctgtgtggtctggaatgggtttcctcatctgttaaggagagaaactgacacccatccataagcatgagaagaagagtaagtgagcaaggctgcctggcacatagcaggtctactgtaaatgttcctttcaaatcctccccttcctgctttctaatcatgctaccctaagattgaaactggtggttataggagaatatcatcccttcctttcttccttcccccctccctttttttcccactccctgcagacagaattggcattttccagaggaagaatagatgtttgattttgtgatccaaattgaagttcctctttgccagaaaacacttctccatatgtttgagattccttattaagggaaaaaaattcatgtttacgttgaggtaaaaatgacacttggttttaccttctgtggtaggcagaataaggttgtctccccaacaaaaaaaaaaaaacaaaaaaaacaaaaaaaaccccaaagccaaaaaaaaaaaaaccagaaacaaaaaatcaggtcctaatccctgaacctgtatatgtcatcttgtacagggaaagggtctttgtagatgtgattaagttaaggatcttgatttggggagattatcctggattatccaggtaggtcctgaaggcaagaatgtgcatttttgtaagggagaggcagagggtgatttgaacatgcacagagaaggcagtgagacagagatgcagggatttgaaggtgctggccttgaagattggagtgatgtagccacaagccaaggaatgccatcagctgctagaaagaagctgaaacagacaaggagcagactctacccagagcctccagagggagtgcagccctactgatgccttgatttcagaacagcaatactgattgccaaccttgtgcctgcagaactgtgagagaataagccactgagtttgtgggaatttgttacagcagccataagaaatggacacaccttcatactattgggacaaacctctggccagtctggcttgtggccacatttttctgagagagtcaacaccatgggtacctatagatgccagggggtgggaatgcaacctaccagagatttaaccaagctctggtcctgtgtatgggctctcacctgccaaaggtgcagcagttgcttgtatgtttcaggattaatgatcaaaggcagcaggtctgataatagggcctgacttttgtggccatgcagtcggagccttgatgatgatataagttaaggagcttcagtgactagagacgtggcccagccctccaagaatgacactgagcggctgagatagccatcatatttcatctgatgtgccagctctgattgctgggggagttgccaggttgttgagaagcttgaggctgagactaagctgcaggcaaagtagaaacaagctgctcaagaacctgtgctttggtgctgctgcacctatgtaaggcagaagtgggcttcagagccatggttctcatttgccttgttgtgatgtgtgatctactgtgagatgggttgcaagtaatttgttaccaatattaaaatgctgccttttgcagaagatttacttcttttaatagattggggcagattcatggtggttttgctaacttgcattctgatatgtgttcttgagtagggcagaaaggggtggagttttagatagcacacaggaattgctcataatcttggggacactaggctggcaggtgagtcatggagataaaaagtgtctgagagccatgaccaaggaacatttaccgcttccctcaggtcgacaaatatgggtcagatgtgtgtcatctcccacccttgtgtccatggcagacatcactaattgatgtgtgtgatctccctactcttgtgcccatgacagacatcactaattgatgtgagtgatctccctacccttgtgcccatggcagatatcactaattcatgtgtgtgatctccctacccttgtgcgtacagcagacatcactaattgatcatggcactgttaggcttgaaatcaggcacagaatacttctcaacacagtcatttggttgtccactgccatttgatcaatgggtaagaggagagcagaggaaacgataagtgaaggtaaaagtagtatgagttttgtatttttgaactgtcatttaatttttatgttattggatatgggaaacagtattaccactaccagttgatcagggttgacctttgacatgacatacatttgccattcctgctaattccttccccagctttaagagaatctgccctaattcccagcatttttgctggtctttcccaagtttcttttggcatccgttaacaaaaggtctaacctttttcccctttcatcagtaaagataagctgcaggtagtaaaacgggttcccaatttagcatggctcctctttcagagggcagacatctaaggagaggtcagccgctccactcccctagcccctgactttcctctggggcccagggttcacacaggagttacagggattagatttagaaatcagcaactctcctaagatgagtattggctgttcttttttttgaaggtgagagtcttggtcagatggcttgagcacgcatggccgtgcaccaggttcccagaggcgcaggcaagagggctgcatccaagttgtcctggaaaccgtgctttttttttcacatttagggctgaaggccagttgcttgctgcctgggtgggggaaataggaaggagcagccagggttcggcccctgggcagaaggatatggtgagattaagagtgggtcaggggttgtggggtaaggaggattgagggaggaggaggtgaagatgaaatgcaaagttgtgtcttagaagttactggcaggttggcattgtgaacttgttatctgtttgacatgacaccccagggagtggctggagagacagcagctgtcacggtcatttctggaggaggaatgactctggctgaatttgcattaaggatttcctaccagggttgccaagtgattatcccatagggagattctgagatctcactctttctcctttttgtatatatttataggagaatgcttatctacgttgcctagggcacgctgtcctttctcccttcctcccttccttcattccttttctccttccttcctttcttcagcatttttgagcgtgcactgggcaccaagtactggcttacataccgggatttggcaataaataaaacagtccctgcttttgtgaagcttacattctggtggggaccgaggtggggagcaggagagacaaacaataaacaaacaaatgaacctataacatggcaggtagtgataagtgctaagatggagaagactgaagataagagggcacaggctggtggagagggctgggaggtctttgggatgggaaatctacttgaatgagtgcaagccgagcagagaggggagggcttcacagacatctcggggaagagagttcctggcagagggagctgctagtgcaaaggccctgagatggaactgtgctggcatgttcaaagagcagcctggaggacagtgtggctggaccggtggtgcaggggtaatagcagattaagccagtgagtttatgcagggccaggccacatagggtcttctaggctatggcaaagaccctggcagccatttaagcaggtggggagactgtggagggtgtaacgcaggggagggcatgagcagacctgtattttagaaggggccactctggctgcttcatgggaaatgagccacagggggccagggtggaagcaggaaggactgctgggtccagtagcacaggttgtgccctgctcaagagtacagagtcaaggctggaaggagggtcaggaggctgtgtccatgcaaggggagcatctttctggaattcatccaaggtgccctaaggctaatgggactcagctagtttgtaaactacttttgctacttattaatatgtcatagacatttcccccatgtcttcaaatagtctttgacaacatgctttttaatagttgtgcagtattacatcacttggacgtactatactgtaattaatctgccatgttagacattttacttattcccagttattcactattttttaaatgtgctgatggatgtcattgtgcataaatctccacgtacatctctgattatttccctgggtaatatttctagaaatggaatggttgggttaaataagatgcatttttaagcctcttggttattaaattactttgcagataactgagccgaggcttaagaagggtgagtaactggcctccaggcacaaagccaggaagtggtagggcaggatttgaatgcaggcatgtcggttttgagatttggagatctatcttctcccccaccgcccccgtcataccacactaaggacagcttagatgtcactcaactcacactcagccaaaggccaggtagcctcagatttggtggccttgatgaagatgatgatgatggctgaggagttgaaactagtcagctttctttaatcagctctgtgtcaggaactatattcagtacagattgtgcatattcccactggaccctcagaggaacctaagagcagtaatatttttagttccattttatacctggggacactgaaggtcagagaggttaagcagcctacccagggtcacacagctggagaacggggaagccaggaatgagccctgtgtaataccttcattcttaaccattcccagctatagggccttccaagataggaactatgcccactagtcccttgaattataaatactagctcatataggctgctgattcacttcacagtccacatttggtctgacagcttctgcactcttgcagctttaaaaataattgttaccattattattaccatattacttctatgactatgtattatatgataatggtaatatatatgctggtatatgcatagtattatatacactaaccttatatatattacattactgttacaacatgttattacaattactactattattgctgtacatcattactatgaatactatattattaccattcccatgctccttgttgctcattctggtgtccaggtggaagggacaagaccacgttttcctcatagcagagtgcaggggcaaaaggatgagcaaaaacatctcatgcctctgaagttattgcctcatgacattattctaatactcatagcaacaacaactattatgattactatgttaaacataggagctgatagttccacgccagctccactcagtcttgctggcttttctctcaacaactccttggggtagatacttttattgcacccattttacaggtggggaaactgaggcccagaaggtttcatgacttattcaagatctcacagcttggcactgacatattttttaacagctttattgaggcttgatttacacacaatcagctggaagtattcatttacttatttatttaaggtgggaacttgctgtgtttcccaggctggagtggagtggcgtgatcttggctcactgcagcctctacctcctgggttcaagcaattcttccacgtcagcctccctagtagctgggattaatagggcatgccaccatgcctgacttattttttgcactttttagtagagatgaggtttcaccatgttggccaggctggtcttgaacttctgacctcaggtgatccacccacctcgacctcccaaagtgctgggattacaggcatgagccaccacacccagccagctggaagtatttaaagtatgatttgaggttgtgacgttgcatatgccagtgaaatcgccaccactgtcgagatggtgacatctctggggctctggtgctgatgcaggtatgaccctttgtgggaagccctcataagtccatgtatggtgcctccttcagctctctcacccatcccattgatcccaagaggaaggtctcagcatctgctgagctttctcacaggtaatgttcctgcctacactctcttcctcctgtccccacttgcaacagtgctttctgtggctaaggaccggaattcatgaggctgagtgacagtggaaatttattactgggatggttcctctagcaagaggggcacagtgggggcaaaatgcaagggagatgggacctagacagcagcccctcccgagagacctgccggacactcccccagggccgcttgcagaagacagggcagggagaaagacctagtggagattgtcctccatggagcccctccaccttccactctttagcttgtgaaccttatttactctgcagtactgttctcactttcacacacgcatgcgtttcatgactccctggggtacccactttgcttctggggagcttgctgtgtaccgttaattgttatattcgcctcacatcacgcttagttaatatttagataaactgtgtgagcaaaatgattttaggttgtgtgtgtgttccactgctggaaacctctctgtgacccaatgcagtgatgcacccgtttttgagctgggtccccttgggtatggagaggttaagtaactgatgtcaaatcacagagcctggaagggcagagcctagaaggaggccatgacttttattcaattaggcttggcccactgaaaagctccctccttcaggcatggagggtggagagctgcatacttccaggtgaagagaaaaactagggtcatccaccacacaactgccccaggctaggagaggatccctcttgctacaataatcgttcctgaacttgtctgcccattgaaaccacctgcgtactccaaactgcactgaagcatggggcccgtcgctagacattctgattttattggtctgggatgcagcctgggctttagaatttttaaaagatccccaggggattctaatgtgcaaccaaatttaggtctagagtctggcacagtgctgtctaatcagaatacgagagagccccatacatactttgatgttttctagtagccatgtttttaaaaaataaaataaacaggtgaaattaattctaattatgtattttagcccaatatatctaaaatactatcatttgaccatgttattttaaaaattaatgagatgttttaaatcttttttttgctcatggtaggtccttgaaatccagcatgtttttataattacagcacatctcagcttagaccagccacttttcaaatacacagtaattgcatgtagctagtggctactgagttggacattgcagatcgggcatatagtaagtgctcaatgaaaaatttttgaacacttgaacaaataatggaggcgtcatgtgcaatatctgcagtcgtgagactgggtaactgttccaaaggtaggaaggtgtggtttcttggcagagtcctctctagagaacggttctggttatgtcttaggatccaggcatcggacacctctcctacctatgaagtcttcatcagctttgtcctgctcctgcactctgctccatgcattggtgacatatgcctcttagactgtgatgcctcgatgccctaggctcattctgtcattgtcatcatctgtatcacatactatcattttctctttatgtgtctgcttctcatatatcctattagctcctcaaggccctagccatgtcctcattaatctctgtatccctattggccagcatttaatagatgtttgtggaatgaagtaataaacgaacaatcacatggcgaggagatttgactgtcatcaagcccagttttatagggcaagactggccagcgcaggtcttaggtggaaggcagggctggctcaatgcatatttgtagtctggttattagaaattgtaagcaatgtatcttagttagcgattactgcatactgctgggtaacaaaccaccccccactcagtcttttctgacaagcatttatttcttgtgcccaggcctgtgggttggctgggtttggctgattcctgatgtgcttggctgagtttggctccaggcagtcggtaaggtgctggtgtgccccatgtttctcattctggggtgccggctgaaggggcagagcatattcttctcatggcagatggtaggcatgcaagctgatgagcagaaacagtctgtacctcttaaaaccttggcttggaacagtcactgtcacctcccttgcatttcattgcccaaagcaagtcactgggccaagcccagagtcagtggggcagagacatggaggggcatgaatatgagttgaacaatcatcccatctattactctaaaatatggtttcctggctaagggtgatggtgttcctgcctctgaaaacccatcccttatctaagtggttattgacttcagcctgtttctcaacgtaggaagaaaggtgggtcagggattttattaaccatggttgcttggctgcacccaggctgtttctgttttatttgacattggctatcttgttttctactcttttgaccctgggaattggttaacctaagaattcatgctaaactctcttcttgctcttgagggaccagtcaaatcagtccctgatatataggttatcccagctgtgcagcacatgcagattgtgtgaacacccatgcgggcgcatgtacatactatggttctacatgccccttgtcaaagggaggatgtggctgtccagaggctgaccagagcttacagtggctctcagtgtgtcctgctcagctgtgcacccattgtagagttgcctgcatgagaagccttccctgaggtttaagaaaatggagcactcatttactgtccccttggtaaccttcagctctactgggctggagggcagggggacgtctttgtgcagtgcagctgcagaggagactcacaaggtgagagggttgggggaaaggagacgtgaggctggagcagtggtcattcttccagctctctggcttggaccttccaagttcactgccattccagagaccttgccagagtccacagttgagctcagaccagggacttcgggccatttccagaggaacctgcttgcagcattctgttttgagtgaagacgctgcttccaatgaagcagaatggaactcctggcttgcctcctctccctcctgcagcctgcaggcctaagtgggctctgaggagctcagtcttggctgtgaacaggagaacaattttaccctgaactagcctaaccctgcttctttctccagtcttctcctggtcagatttggctgcttttagcatctgtgtctcccattggggtgcaggggagtgagggggcagtgggacatccttttagttggttggggtctctggggaagcaggagctttgaacgcagtttgaacccctgagcgctcaagttccttttctcttggcacagtatgatttcctgtttcgaagaaaaaaaccccagagttttaagaccttaaaaaaaaaaaaaaaggcacttggacatgaaatggctcttacaaaacagcatgttgatgagttaagtataaatgaatcagagacatatggattaaattttccttgcaatccacaggggctttaaaattaggggaagagtgtttgttaaaacgtgtgtgtctctgccagggtctgggacagaattggaggctgtgggattgctggagaagccttacacccctcccctccccaactttccctaccgtgataatagggcttggagccaaggaagttactacaagtcttaggttccttcttgtttactcctcaagcctaaagcccttttaattgcttttaattgaattgttcctcatatatctcccctgtgccttcaaatgggggaacaggccaacatctaactcttgcagtgactttgagccagcggggtgaaggcaattgatgtgagccacaatgacatgtgagatattactgcccactccttcttgactatgaactgtcccatcttggcccatactgtcttaacccttccaggcaacacaaataatctggtgtggttcagacacgctattagaaaactcctggccgggcgcggtggctcatgcctataatcccagcactttgggagactgaggcaggtggatcacttgaggtcaggagtttgagaacaacctggccaaatggtaaaaccttgtccctactaaaaatagaaaaattagctgggcatggtggtgggtgcctataatcccagctactccagagaggctgaggcaggagaattgcttgaacctgggaggcagaggttgcagtgagccgagattgggccgttgcactccagcctgggtgacaagagggagactctgtctccctcccaaaaaagaaataccactcccctctctcctgtggccaggaacagaggaccgtgcaggggtggagaggagggttggtaacttctgttgcagatctctgtgatactattcttgaaatcaggagaaggtgggagctgcaaagtcttttagtctcctggtaggaataaggacaccaaagggatgattggtttttcccacccgcagtcatccagacattccaaagtatgttggccttgaagtttttatccttccctcttaatttttgaccaaggagcagagaaacactgtatatttggagaaaccctgagtaagcttctctgtgttgttgttttgcctgagagccttttgggcaagagaagtctttgtggaagcccctgtgtaaaagagataaagagctgaatcagataaatcaggggtaaacatctcccggccccagttagaccccgattccgtttccttcccggcttagtgggacctgtaggtctcttgggaacacactctgcaagcctattagtattctagagtaggaatcactacattctttggctcttagctccagcagcaaaattaataagtgtctcatggacattatgttgagtgaaagaagccagacataagagagaacatgcaatgtgattccatttatatgaagttcagaaataagcaaaactaatcaatgtggatggaagtcagatagcagttgtttctgataatgattgggtgagagcatgagagaactttcttgggacactggaaacgttctgcattttcatctgggtggtggtgatacaggtgtacacacatgcaaaaacttcctgagctgtacacttcagatcagcactcattgcatgtatgtgatctgttcattaaaaagtaaaaaattcattctctcttcttccccgctgctgaagtctgggggcaccatggtcaggtgaacctcttttttttttttttttttgagacagagtctcactttgtcacccaggctggagtgcagtggcacgatctcggctcactgcaagctccacctcccgggttcactccattctcctgcctcagcctcccaagtagctgggactacaggtgtgcgccaccacgcctggctaattttttttgtattttcagtagggacggggtttcaccgtgttagtcaggatggtctccatctcctggcctcgtgatctgcctgcctcagcctcccaaagtgctggaggtgaaccttttagagtctgagcttggagattgttgtaggaatgagggcagagcccagggggagcaaggcataagaagggttgcccttggaaagaaaaagcaaagcagggttttggtgacacagagggccacagcagagttgagtgcacctgaatgggctctgatcgaatggcctcagcctcatgagaaatgcacagtaaggtggttggggagggtttggcagggccctggaggttgggggctgttaccatatggaggaacaagcgggcatgggaaccagccctgtctcaggtacttcagccccatttatggagagaccacttttgcccctctctgcgccattttgacatgaagaggattctgggggctcagaaggaagggggcactgcccacacagcccttgcctcctaccctttccgattcagagggactgggcgtgttggaggcacacagaggatggagtgtccacgaccagcccactaggattccagaaagggcccatgcctgtcataggcagttggaagtttgcttgaagagatggaatgagacttgttgggctagcatgtctgggctctggttgggaaacatggtcggtcagtgggattgaggaatgtggcctggacaaaatgtgacggcagtttgcatagttctgaggcctggatgggagtggtggcaggggcgcacttggggtgtcctggttgtccagcaggtgtgggacacatcccacctgtcccactccaccccatccttctgtcaccttctgagcctaggtactggtcattggatccaggccctaaggctttctgtctcatttctagggtccatatatggaggcctcaatctcagcctggccaggcacactcacgcaggagggagatttcaacaagctttgggaaacagttttctttccaacccaagcagctgccctttgccaatctgtgctagaagtgaactatacacagctctgtttaagaattccccttccagctaattcatcccagcctctctccgcttagtgcaaggacaggggaactgagcatggtgactctcagagacttaagctgccatgtagtggcactttcattctcgaggcataagtcattttttttggccttgactggttggaccaacactgccagttgcacctgtgtgcccactttccttccttcccaatggagatggcaaactgcttccatatggaggtcattggcaccatgcttgcttcccctgcctgctgctctccacctctgatgaaaccaggccagggactaaccagcctcagttgtttggactctgggtctttgctcctgccttccaatctggggctctttggccatgagattggaagagccacgtcactgtggggtttagccaaacctactgggacttcctgtaagtgatgtttggtcctcaggcccagggtggcttttggagtaacttttccttgtaaattgccagttgcctttgggctctcaaaaatcagcatgaagaagataaacaaaaagcaggaacaggcaattcccagaattagaaagtaaaatggctaataaacatatggaaatttgttcagcttaagtagggatcaaagaaacattaattaaatcagttacaagattctgttctcccccattaaattggcaaaaataatacatgatggtttagatatagagaaaagggggctctcattcccctgctatagggaattaaattggtacaactttaccagagggcttgtttgacagtatttttcaaaaaccttaaaaaagatattctctttgactgagcaattccatgttttggcatgttacttaccttaaggaaataatcagagatggccacaaaagttcacatacaaggttgtgtattgaagtgctatttgtaatgatggaaaattggaaatgattgaaatgtccaacaatacaaaatctgttatgtaaatcatggttcattcaaataatgaaacaccatgaaaccattaaaatatgttgtagaacaatatgtaaagacatgaaaaatatttacggtatttgttacatagaaaaagtcagattgtatttaatataatcctaattttatattgacaacaaaaaatccatattggtgcatagaaaaaaaagagttggaaagatatatgccagccatttaattggggttatttctaggtttggagatgatgggtgatttttatttttattttcttcgtgcttttctttcgccatcttcaagttagggatttaatgcaaacttctttgaattttaaattgtttcccattttttattcataatgtattgatgactgtcctttacttaaattattgcatagacttttgtcagttcatgtaagtggaattttggagtcaaatggcatgtccactaaatccatgttgcttttgtaattaaaaacaaaattaaatccctttagggttttgttctagaattctcttgccactaatcaacccctatcagctggctgtatgctcaagtctgctctccctttaagctatgagctgagagcacgtgcctgccagtgccctggagacagaatttgtcagggaggtaggctctgccaccatttttcccaattcctctctgtacttgtctgcctcctaaacttctggaagcaggggcatcctggtatatccgtccgctttcttggcacctgtgactgatggcaggtgcgctggggaagggagaaaagctctaatgtgtgtgaggacctgctctgtgctagctgctggcctagctcttgtcaaaacgctgatcgtctttgatgactctcttacttcacatctaatcccagtctctttgttctgacttcaaactgtgtcacgagtctaaccatttcccagcacctccacaagtaccacctagttcctgccaccatcccttcttgctccacagctgtgaaggctgcccgcaaacgccacccctccgccaacaccacatccaccgactgggctccccatgttcacctgttcacctgtgctccctgcactcccatctctacccagcagccagaggggtcctttgagaacacactgtgaggctccctccagtccttcagacccactggggtgccccatcgcatgcagcggaaagccaaaggccccacacctcctgacctaagcccctgccactttcccccgtgctcgtccactctggccacatcagcctttttgctgttgcccagatatagaagaacatcttcccttaggacctttgccctgtgtctccctctgcctggagtgtcgcttccccaggactccttatggttcatcccctgctgagcttaggtcccagttctgaggtcacaaggtggcagaggccttcacttacctcacttttcttttgttgttgttgttgtttttaactttgagatggagtctcactctgttgcccaggctggagtgcaatggtgcgatcttggctcactgcaacctccacctcccgggttcaagtgattctcctgcgtcagcctcctgagtagctgagattacaggcgtgcaccaccatgtccagctaatttttgtatttttagtagagacagggtttcgccatgttggccaggctggtctttgaactcctgacttcaagtgatcctaggcctcccgaagtgccgggattacaggcgtgagccaccgcaccaggcctgaccccacttttctttaaccccactttactattatcgaagcacctgttgggacgtgccatgtgaggtatgtgcttcttcgccaataaggacaaagctccctgagagcagggactttctgtattgctgtacctctacccccagaacatacaatagggtgtacattgcaacagaccctgagcccatgctaagaggacagagctgaggaggtgccgagatgtcaagagacccatctgttcaaggacatgatgtatacaccttatagattcaagcttctgtccaactctgaatgtgtttgtcctctattcttagaggcatggcccctgggcagggggttgctgtctttgctgccattctcaaaccaatgggagctgctggctggatccctgtagcccaggaggcctgtggggcctgttaggacatgatccgagatttcctgtgagattctgtctttgcagcccacactgctctgtcctcagttggctgtgttgtgtggttattggtgccagtgtttctaagttgtgtgtctgggaaggagacccacctgttattttacaaacagggtaaagttccttgcctagaggctcaggcaggaaacggggccacatcccaactccgtgacagctccaagtacaggagggaggtttttagagtgtttcactcagtcttcccacttgctgcctcatccttgtcattatttatgatttgttgagtacccctactgtgttcagcaggctaggagatataacgtcgtcgttgttcccctgcctgaggccttggagtctaatgtagccagacaaatgactcaggcataaaccaccttcccaggaaggtgcttacttctccaaagtgccgggtttctcaaggttttgatttgcacgtggctttccatttttaaactcccatggggaggcgtggagacaactctggggtgagggcgagggtgggggaggcagggctgggaaggcagactggaaaatgttggctacgtaagggtttttgagaagaaatggcattccaggcagcatttctgagccatgcagttcgtgactcaagataaaacattggtctggggtcaagatgttgctgagaacagagaaagtgaaggcaaaaacccagtgaagggagcaggaatgggaggaaggggccagaagccaggggaaagtttagcaactgaaggtagagcagaaatatttatatccatccaactgtccattccttcatttatctgcttggagaaatgcagtttcatcctcaaaaatgttttatttatttatttatttgatggagtctagctctgtcaccctggctggagtgcagtggcatgatctcggctcgttgcaacctccgcctcctaggttcaagcgattctcatgcctcagcctcccgagtactgggactacaggcacatggcactgcacccggctaattttttgtatttttggtagaggtgggggtttcaccatgttcaccaggctggtctcaaactcctgacctcaggtgatccacccacctcggattcccaaagtgttgagattgcaggcatgagccactgcacccagcctcaaaagtgttttaaaacctgtggttccctgcttgctggataatgttaggccccctttgtgctttctctcatagtacactgtacttttccttcattgcattcgtcacagctttaagtgcttttttttttttttttttacatatgtatacttacttgataagtcatcagctccctcctaatgctctgtgaagacaagttccctgtctattttcttcttgtatcccctgtctgagagcagtttttggcatgtggtaggtgtttacattgaaatattatttgaataaatgaaaccatcaatgaaggcagtgaaagaagcctcatctggtgcactaggggattagaggatgatgtagtgaggggtcaggagaggacttgaaagaggaaatcccacttaatctgctctgatatggtttggctgtctccccacccaaatctcatcttgaattgtggctcctataattcccatatgttgtgggagggactcagtgggaggtaactgaatcatgggagtgggttttccagtgctggtcttatgatagtgaataagtctcatgagatctgatggttttataaagggcagttcccctgcacacatcctcttacctgccaccatgtaaaacatatcttgcttccaccttagccttctgccataattgtgaggcctccccagcaaagtggaactatgagtccattaaacctctttttctttataaattacgcagtctcaggtatgtctttattagcagcatgagaacagactaatacatgctctgtgatgcttcctaaatctacaacaatagcaccaccaccatcaaaaccagtgtctagcctaagctgaaagctgagtgtgtgccaggctctgagtttagtgcttcacatacatgatctcatagaaagtacgtatgactatccttatttcgcaggtgaggaaactgaagcccaaggaagctgaataatttgtccccaggcacatggtcagcaagtagtagaattgggactctcatgtgacaccccctgcccccaccaagtggtgctcagggtccctctactttgtggcctacaaaacagtatctactgttgttgcaaataaccatcatggaaccgaagcaagagaaattgcagctgggtggagggaattttgaggtacatggatgctcttcgagagagagacttttagaaatacagcaacaacaacaacaacaacaacaaacataaagaaaaaagggagacttctcctttggagacttataagaagggaatgtgaatggttagggtgaagtggctctgctggggtcctctttagggacacagtggggctcaggattctcctgaggttcctttcagggcgttgtctattaggaccgttaagctgctaatggagggtgacagtgcttgacatttgggtaattaaaacatctactgactgaataataactttttattgacagtcatactggtgaaggcaaaattaatttgatttttgacatcctcgctgagttcccggctagacaggggctgacgtcatgcagatagagttgttgaccctgtggatggtggctcaggccctcgggtgggcttggctcaggcccagcatgcaggagccagggtggtcaagttcatggcagggaggcccagctgatccaggcagctgagggatgcacactgcagggtcactgtacagtttacatgtaggttccaacactaattctagaaggagtttggggagatattgtttaaggtggaaatgtgaggtgccttatagtccattaatagttagaacaaccccctggagcttacaggtcagacaggaatcgtggagtggaattgggtgtaaggggaaaagggtgccgggagatgtagaaagtcccttacatcatacatcagctcacttgattccaataactatcataggtgattattttattcccattttacagatgggaaaatggaggttctgagagctctggcactgtgccttaaagatagcacgatttaaggaccggcgttgctttctgactaggtctgtcaattcgaatcccaaggaacctgtatatcaagatgaatttctctagtttgatggtagaaatgggatggtccaggaaaagagagattttctttggcagagccacaggaaaaccacatcatatacggctattgatgtcatcatttactagcaagaggatgctgggtgggagtgacccaagccaaagggtgtttgttgctctttccatgattagggcctgggtgagaatcctgtctccacttctctcggagcttgagtcatccaggggacaggatcagcctgatgtcagagacagggactcaccagtggtctagagctgcactctccaatacgatggctgctagccgtgtgtgggcaatttaaattaactaaaatgaaataaaacttaaaaaccagcttctcagaagaagtagccacatttcaagagctcagtaaccacatgtggccagtggccaccattttgggcagtgccatgcacttcatcattctaatggatggagctggaccagaggccacctggttctttccggcagcaagacaagagaggacactgcttttatttccaagctgtatgactttgagtataatacttagtcctctgagtctctgtctcctcttctgtgaagtgggaagtgggggctacagtgagaactaaacccaatggtgtacattaagcttgctccatggcgcttggcacatggtcggtgttcatcaggggctggtagcacctgcatattccggagagacagagacaagcccccttggtctggtatatttcttctacagatcagtttccatttggtgagttacctgaggccacacatcttcctgcctggttgcttctggaatacataataccagaaacaaagaaacaaacaaagaaataaaaacagaaaacaaaccattggagacacatgcttttttctcagtcttcccccatgaacacccctgtcttgccatcctaccaagcctctctatttcctcttccctgcggggtggggcgggggggtgttgcagcactctggaccctcccccagggcttgcatccttagattttctctcttgccttcttctctctttgtccttcaggcaaagataacaagttcaactatttaactcctggagcttgttaatgagttatagaatctccattattttgtacctgggcagcctaagggtggctgttaatggcccacaggaaagcactctgggttttctttgcttatactgccctcccttcctggaagaaggggcggcaggatgtaaactggcccatggttgtccagcttgagcatgcttatgagccacctgaaaggcttgtgacaacacccgcctctgggccccacccctgactcttggattcagtatatcagtaacaagctgggagcttgactttctcaccagtttccaggtgatgctgctgctgctgacctggggctcacactatgggaatcactgttttaggccatgcttcccagtcagctgaatgctcttgaacaatctacattagcattacacagagggcttgttaacaggcagatcgctgggcccctgccccagagtttctcttccaattgtgggagaaggatggaacccaagaatgtgcatttttaacaagatcccaggtgaggctgatgctgctggtctgagaaccaggctttgagaaccgcaggtgtctttacaccaatgttattaatagctctgggatctgtcaggcatgagagcaaagcctgtctcaccactccgtgaccctcaagctacctgagccccatttttcccatctgtcaaatgggaactatgggcttctaagattgttgtgaggattgaataaactaatggttgatgcttaataaatgcttggtttttctctcctctgaaggtgagctgtcttgactgggctgatgctgggctgccaggaaaaagaacacgcataactccggattggcccatgatggcttcctgctgtggcccagccagcactgcccgctttccctctcttgctcctcagcctggcagtccttattagcctctcccccaaaagccaggttgccaaacctctcagccttcaagtgcccatcatacctctgccctcttggtacaacttccctgaattcttcaaaccaagggtgtctcatcaaattgtgcattaactgtgttacaataagaataaactgtgtttatttctagatggcctggagcttttggctgtcttgcttaaatgtgactcaaagcagttaaaaaataaagaaggaaataaaatgaaaaacaacaacggaaagaagaaaagggcaacctcagcctgatgaaagacttggaagagtgagacctctccctctccggaataaattgctagttgcctttcagtgtcttgcactgtaattgattcaaagaaaaccaaaatcagccctgagctgagctggtctgcgtcactctgctctgggactcccgagagcccctgaggggagtatgaaaaggatgtttggggccaggcgcggtagcttatgcctgtaatcccagcactttgggaggctgaggcagtcggatcatgaggtcaggagttcgagaccagtctgaccaacatagtgaaaccccatctctactgaaaatacaaaaaattagccaggcatggtggcggtgcctgtaatcccagctactcaggaggctgaggcaggagaattccttgaacccgggaggcggaggttacagggagccgagatcacaccactgcactccagtcagggcaacagtgcaagactccatctcaaaaaaaaaaaaaaaaaaagatgtttgattttgcctggggtctgtgagaaccctggaaccctggaaatctttccaggattctccatggactgtgttactctgccagggcaggaactactaagagccaaggcaccaaaagaggactcaaaagctggacagaggcaaggagtatggggcctcagaagagcaaacacaaaaacaaaaattctctgcctgctaattcctacttctggcacagttgtggtcctttatagcataggtagtcaatccattttctctagtattctcccataaggagcatcagcgctttcaagctatgtaacttggagtatgttatttagtctccctcagcgatcctagctataaaatgggaataataacgtcttacctcttaggcccactgctcagattgaaattatgttcataaaatcaagcagtatgctgcctaaccataataggtgcacaataaatatctgttcctttttccttatctcagctgtatcagaagcactgatgtagctgttcagagataaaggtgctgctcttggatgcattagcttgtgccagcccatataacttccctggtattctggccttggccaagtgagactgacacactggaagagaaacccaaacagaagtgacaggttgaaatctcggcagcaggcactgtggctccctccacctgcagcttgtgctcaggaaggaagcaggcaaggtgaagagaggcctcccagccaggctgctccctgcagagtcagtcaggaggaaagtagcacccgcttctgccctcatcgctgggatgcagtgagtcctcgggcctcaggtgcaaggaggtatgtgcaatcctcagttcatcgggcctgggacttaatcggagctgcctcctgcatgactgccatccttcttccctgggcagtttagactcagtgaagatgagttaggacatgaagaatgcagtaggattgaaccctaatcagatcattactacagcaagagaaaaaaatcattccaggcccaggctgatgtctctttctgtatcttttatttatttcctaatagcctttatttatctgtttttctgctagagggctaggaatcttccttctcctcctcctttttatcttgccttccttttctctctccttgggttttggttatggcttttctttttgggtgctggttaaatgtggtcctgaggccccttgttgtcaagaacatcattcactgatttctagttcaagacaagaagaaacattttgctgtggtgctggctcaggcttttactaccaggcttccctgcagacctaggtggatgttgagtggacaggtggttgggcttgagtttcactgggctgggggagtgggtggaggggagtgaggagaggctactggagatcaggaaggaaggaggggagtggatctgggaatgggagtttggactagggctgatttttggccacttgaatttaaggagtcctcctgacatgaccttctctaattgaaggaagcaaagctgatttctgcctctgtatcccttgtcatgtttctctgctcctttcaccacatccagacctgtgatgactctgtatgtgaatggccagaatgcccacagagaccccagcgcccctctctgtgggtagcccgcccctgcttgccttccttctggctcaagttgggggacgatcaaggcaggagcttgaagggaaagaggagggctcttgctgtctctggtagacctggcagaggtaactctaaggaaactgcccaaggctgctagatctcagggcatttggtacttcctagatctccttctagtctttaccttttctcctcttctcattcgtttttagaatagcattgcccatagaggccagttttctgttaaattcatagaggacgtctcatatttctctattgataaccctgaatcacatggtagcactgaaggatgctggcaggaaggaagaagggagcaaaaagaaacagctgtgagatggatttggggcagctgaggttgcaacatgttctgcagtaacaagtgtatcccttcctgtggtgtcctggatctttctgagatcgccctagactctcaacagcgacctgtgagttctgactttccaagtgccagagaggaggcaccttgtatttctgggctgttcggggcctgagatccctggccttttcaccaagccagcttccctctgtgagttcagcaaatgtatttggacgtgtaccatgtaaacagtgaaacactaaaggagagaatgagaagaggcagatggaaagctggagctggcatctggcagtttggaagcaaaatcctacgtgttctgtgccaatttccttcatatcgtggccccatctgcctccagccctgttaacacaggcctgggcatctctggatcctgagtgatagtgttctgcttcttgctccttagcatcttccattggcattcctctccaagaagcatgcttcttcacgggaggttccggtgtagctctgcctacacccaggctccacacttccattgctccccctgacaccgctgcatcatccttggaatcccaggtgttagcatgccacctcagttttctgtgtagttctggtagtcttaattaatacctttaattctttccctactctggaaaaacttgttgaatgtgactcatcaagatggtagcaaaccaggacttgaaataataatcataggtctttggggtgctctaccatgagctcatacagcctcctttctgacaaccttttatatggtgatgccactttggattgagaaggcaagaggaacttgcccagaggtggttatgattgatctctttctgcaaggttgtcctaaagtttcatgcttctactgtaggacttgagagtgggactgaagtttcaagatctgaggctgcaatgttgataacttttggcagtcttcatctccccatgattaagccttccttgccggtgaccttcatgtacactccattacagccccataatagccagttcttggcttgctttgtggcttggaatttctcttcaatccagacgtacctacctctctttcttccttcttcctgctctactttcctttttgtaccctaccttgacctctaatctcttggtctcctctgatacctgggtcctcttggctccatttgcttccccatcgagacaaaccccattgttagccagtaaatggcatctccctggagccccaaaatctgctccctccttgcccttcttgctctgcctgctttgacgacccctaccctactgtcctgagttgctgagcaggatagccacgggcccatgctaagtgggttcagtgcagatctgccatgcaaaccccagcaagaccccttgctgctttttggcaggcctttgattcagcttttgttgacctcacagcagctgcttgccttgtctatcctttctgagccctatatcttggcttttaaagtctcagttaatatcttgcatgctttgttgaacatgaagctgcccagtgctggtagtcaaagtattcctttttctaaaccttaatagtgtttttttgttttgttttgttttgttttgtttttttgagatggagtttccctctctcgcccaggctggagtgcaatggcacaatcttggctcactgcagcctccacctcccgggttcaagcaattctcttcctcagcctcctgagtagctgggattacaggtgagcaccaccacacctggctaatatttatgtttttagtagagatgtggtttcaccatgttgtccaggctggtctcgaactcctggcctcaagtgatcccctctcctcagcctcccaaagtgctggggtaacagacgtgagccactgcacctggccataaaccttaatagtgttctgtatcctcaccttttctttcttgtatcacttaaagaaagagtctaggtagttatgtttagtcattaaacatttgcccagtatccactctattcctgaggtaggaatatacatgtaggtaattctctttcctaagatagtcacagcccgtaagatgtggatcctgtaaaaaactgctgtaaaaggtataacaacataatgaggataataacaacatgtgaagagcagtagtcttcattaatgagcacttgctctccatcaagtcctgtgtcaaggacttttcatgtatattacacttaatcttgacctcaatcttgtgacttagggacttacaggattctcattttatagaaaattgagactgagagctcaaataagaggtagagctgggatttgaacccagaatgtgcatttagattctaccaactttggcctcttttctccccaccttccttcaaatgggtggactcatccagggcaggtctagagagccttcagccccctcccacgtcctctctgacctcttggttttcccaagttcatatgtttctgctgaacaagcactgctgctctgacccaccacaaatttagctgctgagcacgtgtagaatcacatcgtgcttttaactgcaggcaaaacccatccccctgggaactgtcccagtttgagggttaaaaaaaataggcagtcatgttaaaatagagataaatactatagacagagagagacatgaaaatagatccaggagggatggtagatattctatctaaatagataccagagataaatacatggaaaccatagataattattgtagggagttatgctcaataggagactctgtggataaatatatagacttcacagatagtagaataatattgaggaagtgaaaaaaaatggcgtgtgggagtctgtacaactctgaggggctgtgctgaatgggactgagccctcagcaccacgtgttgcatggaactgatccaagggaaggtctgaaatacacaggcagcttgcatacttccagaagccatgctgtacactgggtagaaggagtgagtgggattaattgaggactgtgtcagtagggctggagtgggatgggggatgatgaaggcagacctgggagaatgtggcaaggttgagccttttaagttgatgcaggaatgtggaagggccagtggagcctgggagaaaggaactacttggaaagaggagtaaggatcaggcctttccagccaccctactaactgacctgtgtaggtgaatcattattttggcaggctgcctgtacaagagtggggaatgggggcatatgtcaggaggttgctgcccaatgtaagaaccacagagaagaaagtccatcccaggctggcactgttcctgtctttgacgatcatggctctactgtgattgaacatgggattggccaaggctctgcctgcaggtcctcagggcgggtgatggacagctgggataagcttgggagaggcactcactcatatgtgcttctcccctcccttgtctctgttcttctcttccctgtccatccaggaggctgctgggaggactttgcagttctgttggacaaatgttcctatactgtttggctgtggaatttttcattcaagggcctacgaaatgggcagaagagagctgtgggtgtgattcagaaaggcagggctgtgtgtccatttctctatgggctttcagctctttattgaaacaactgagtaggaaggggatctgcaatcattaagtgtgaccttcacatccagatggtgatcccatctcagtatcttactctcctttcccagatgaaagggagagatatctactgtcatggaggaggaacttgtctttaatggccaactacccatcattctccctacatgtctgacgtgcccattgaatatctagccttgttctggggtgagttagggactatggagaatagaaaaagcaaggtctttatcatcagagaattgacattaaaatagtttatgctaaaaagccaagctacagttatctctccataggggagaaaaaacccagatagttgctgcttttgtatcaggagttttgccttctacacatgatttagttactatggcgttctctaaaatgtcataaggcccagatgtgcttttcagggcttagccctgacagtaggccattttggcaaagtcaacttcctctgtaaatcaaggtctctctttctttgtttgacaaggcttatgatgatgtgattcatgaggcatgaagaggatcagacaaggggtatactggagaaactcaacaggtactaacactaccttattagagagtttcagatcagccagttcaacagagaactttaggtacacatctcctgtggagttaaaattccttacctgtttgtacataagagaggttcccataaataagacggaaacagttccaaagaacttttctaataggaacttggctaatcaagtttctagctggacttgtacccagaggatttatgagaacaaaaatcatggggacagtcatccagatggcatctggtaggggtataggttcttctccagcaatattctggggtatctgcccagtcctggctgtgtggaacacccctccctccactccaggcaggagggagggtgtcccagagaatgggtagccctaagcaaccatctggtcaccaagcagagcctcaaaccacctgatttggggacagggaccatatgggcttttcaaggttctaccttgcttacttttgactttagtcttaaagtgctctgaactggaaacaggactaagaagaacgttttctgctagagagctagaagctatgattatatggatttcttcccctggtgttggatgctcctggtggtgggtaggaccatgatcctgtggacagaggatagggccagaactttcagtgcttggttggcctcctatcagtgaggtgctaaggtgacctctaccctctttctatcatgggtagaggaaatacaatcctggagcttgaattggtgcctgtaaaattcagggaacactactgagccatactggggttagttatcgtcacatagttgtcatagatcttgattcagtacaaaaacttgttatcaagcatatgttatgtacctgcaaatgagccaggctttggagatacgaagaaaagcaagatgagatctctgtgcttagaaagccctcagtctgaaagtattattcttacttacaattccttcctccctctcaactgtcaggaaactatgtgttgaggttcatttagcccattgcatgtgggtaagggtgaaggaggcagggagccctaaagtgaagaacagacactgagtctagaatgggactgggacctcagcagcagagacccccataacctcttttgagctaagtttaggctcttcttgaaagctccttggttctgtcatgtccaccctctcgctctggactgcagtggagggggcactggaagttacaatgtggtagctatgggcatagaaaccagacagacctagaccagagtcctagccatgcatgatggagcaaattcaccaacctccatgagacttagtgtcatgatctgtgaaaagggataattgtagaacctacttgatgaggctgtgggagtgtaaaatgggacagtgcattagagaaaaaaaaagaaccaacagtagagaatgtggaggttgtcgatgtgaagtttgcagctggagtaaggaagggtgtggccttgaaggacgagctataaaatcagttggtccatctctaggtgatggtattagatttttaaggcagccataacaaattactgcaaacagcatggcttaaaacaatggaaatgtattctcttactgttttgaaggctaggagtttaaagtaagatatcagcagagccatgctcctgccaaaggctttttaagagaaatctgtctttgtctctttcagcttccagtggcccagacatttcttagcttatatctgtatcaccccactctctgcctctgtctcacctgaccttcttctctgtgtctctgtgtccttttctgtcttttataaggacatctgttgttggctttagggcctgatctaaccctgtacgatctcatcccaatccttattttaattatatctacaaagactctatttccagataaggtcacattctgaggtttgaggtggacatatgtcttttgggagcagaagacactgtacaagtcactacagtgaccaagacagaagcaaaagtagttctattttcatccaattcatctgtttcttctgagctccaggttatttggcctttcatgacaggagaaaagaagttgtggggagtggttcattcattcttccacctattcaacacgtatccattgaacaccaccacatgcgagatggaaacggtgccaggcattggagccataagataaaatagatatgtgcctgctagaggcctggttcagtgctcagttctagctacagatgtgatggacacactcactgtcccaggatagctcagtctccaggagaaggcaggcgggtcatgaggtgaggaccagctacagtgctaagagttctgacagccaccagccagggctctgcgatcacagcagagagacacccagtggggaacacgggttgtccacaaaggcctcctgagaaaagtggcttctgggctgagtgttcagggacatacagaatccattagtgagagaagctgtcttcagacagattggaaatttgtaaaaatgggagacttgagagaacaggacagtttagagagccaccaacagctctgtctggccttgatgcttgcatgagttggtgactggaaagcaagaaatgatgtcgggcagggcttatcttcatccttgtcatcgtcattgttgacatcactggcaggtatggagcactcactatgtgctcctatgaagcaccaagcactcttaacacttcacctgaattaatcttcacagcaaacaaataagggagttgcaccccaggtttatagatgagctgagttcagtaatctgtccaagggatggagcccagtgttgaaccacagcataaggaacttggctgttacccccatccccaaagcactgaaagtgtgtgtgtgggtgagggggatggggaagcccccctactcaccacacatctttacatgaaggaaacaagataatcagaagttcaaatgcctaggattctagaatggggggcctttggcctttggcacaggggaagctgatagagtgggcatatgaagagagaaacccagggctgaccctcagtagcccaaggaaagcaatgttctcacccttctaacaaaaatagtaatggaagcaatgacagaaatgataataaagatagaattcatttggctgtgagtagcagagaagctccaaataacaatggctttttgaaaatggacatttacttctgttttgtgaaaaagaggtttggaaataggcagtccaaggtttttattttggtttggtgatcatcggggtccttttatctaggggctctgccatctttaccttgtagcttcattggctaaattggcagctagggctccagccattgcatcagcatttcatgtgcaggagggaaggagggcagagataggcctacttcatcctatttagggagacttcctaggaattactagccaagacttctgtttatatcccattggctgcaaggggaggtgggaaatgtagtctttatgttgggaagacatgtgctcagctaataacaatgggaaaggggtaggaggcacctgctagtcaatgccagaaactgttatcatttatggagtacttcttgcgcaaaacactttcatccttgtaacacacctctgtgggatatactacagttgtccctcagtattcatgagggaatggttccagaacccacctccccgttctgcggatgatggatgctcaagtccctgatgtaaaatggtacagtatttgcatataacctacacacatcctcccggagactttaaatcatctctagattatgtataaaacttaatacaatgtaagcgctacgtaaatagttgttatcttgtatttttaaaaaatttgtatgattttttattttgttaatttttatttttttccaaatatttttgatctgcggttggctgaatctgcagatgtggaacccacagataccgaaggtcgattgtcctattattacccccgtttgatggataaggggcctgaggctcagaaaggaaactgaggccacagcatgaggaagaggcagagctgagtcccaagcccagctctgagtgcctccacagactggcattttctccatgaagctctcctgcctcacaggggactctaagaaagggttccagaacggagcctccgggccctggaaccagcccagcctctctgacgtctgctctggcctgagttcgccaccctgccaggcaccagatgaagaagcaggaagtgggaaggactggcttagtgagccctcgccctgcgggggcgtgagtgtccgtgggcccatcctctccagccaggcatgccacatgggttccggctgccactctgctcctgctcctgctctgtgccgcttctctgtattatcagcctattctaacctgttgtgggcctgcattcaagatgctcttagcagccacgggctgacccaccccacaccttgtggagggcagcacaagcattccgtgtcccttctgaccactgggggtcaagtagacaattcatttagtggcgggagtgaggccgtggcagggctccctcctcggagctccatttgatggataagcattcaaacttgaccgtactcttttcctgttgcaagtccagatttcatggtcaggtgaaagttaaatttattcatttattttacctttattaaaagcatctctaatgaattattgttttttttcttttagttggttgggggtaagctgactttcttggcaaacaagttattacctgatgccagatttgaaagccgctcaacaagggggtctctttttgaagtattaaatatttcaacataaaaatcaatgaagtacctgaaaaaatggaagtagatgaacaaattaaaaacaacttttttttcttagtgaagactattttaatagttgaaaaaaaaagggaaagaggaaagaggagagaaacatcagacaacccttgtctgatatcaaggtgcaaaaataacccactttgaaatttggggatatattgatagtaaatttaagatgataccaatggctaaaagtaaatattttttgagcaaaaataacttcttacacttggattatgcctccttcttttctttcctgggtgatgaaaatagcctgtgactggggcttcttgcttccacttctaccccaacccatggtctgttctgcacacagcagcctgagccatgtgatgtaagggacaattagctcctgctgttcccccgtgctcagttccaagggcttcccatcaaagtgcctgctcttctggatggtccccatggtcatgcacggcctggcttggggctgcctctctaccctgtctcccccttatcttgccactggtcacttcccctcagtcacgctagccccctcactgttccttgaccatgcagcctcctgtttccctggggactttgcacgtgtgcttcccaccatggagaacaggcttccctgagatggtctcagggccccctacttttttttttttttttttttgagatggagtctcattctgtcacccaggctggagtgcaatagtgcaatcttggatcactgcgacctccacctcctgggtttaagcgagtttcctgcctcagcctcccaagtagctgggattacaggcaactgccaccatgcctggctaatttttgtattttttttagtagagatggagtttcaccatgttggccaggctggtctcaaactcctgacctcaagtaatcttcctgccttggccacccaaattacaggcgtgagccacctcacccagccacagggtgccctccttcacggcaaccaggcctctgctaagatgtcacctccgtgaggaggcttccatgaccttccagactcggtggctttaacaacagaaatctattctggagttcaagctcaaggtagtggtagggttggtttcttcgaatgcctctcttctgggctcttctcattgtatcttcacatggccttccctttgtgtctgtctagtcctaaactcctgttcttctaagaaggacaccagtgacattgggttagggcttgccctaatgacctcattttaacctagttatccccttaaagaccttttctccaaatccagttacattttgaggccctgggtgttataacattaacatataaattttagggggggtcacaatttagcttgtaacacctagtgtcctctttatcccccgaccatagctctgggtagaagcaggtctcactgcacacacgatgggtgttatggaaaatggtgcaaacttcccggcagcatgttccttgtcctgtgttgattgaggtgcctgggggtgcttgccagagagtttggagctgtgcacagagtggaatatgagtggagcatgtgcagagtgaagcatgcatggagaatatttatatgggcctggaataatgtgcattttgtttcaggtgtgtgcctataactaggggtttataggtgatagaggagcaacaatgaaatgaacatgtaggatgtgtgtactgcttaccaagtgaactcctggcttggggtacaaaatcattgtatgttctggactcttgtctcccagcagagccatcgctgatctatctgaattacagattagctggcaccgaagggactgcagaatccatttaaatggatagctctctaatttattaaagggcttatttatgctgttgatatcgggtgctcatcaaattcttggagtggcacaagcccctttcctgccctctgcttgccattgctgctggaagattttctcttttccaggagagctctaaatggctgtagccagagggctgtgtgtgtgtgtgtgtgtgtgtgtgtgtgtttgtgtgtgagtgaaataaaggggccatgcaccttctgtgggctttccatgtttcttgcagctttgcaattagcttgctgctgatggtgaacatctaaatctctggaagaagctagagtaccacatttttctctgctggctcagaggagaatgaaggtggacacttggctgacaactaggtcctccctttactgcctccatcatcatgataattatcatcatcatcatcccatgtgcaatgacattgagatttctggaatctgacatgtagctcttaaattgctttcctgaacatgaccctgcttcagactcttccagccatgtggcttgtgggcaggttaggggaggatgcaacagatggggatggatatatctgtgcattcaagagtccttctgctgggttagccggatagttctgttctcaggaacgggcattggggcatggtggagggtagtggtgctaggtgtgctttgggccagaattttgggaaaagaagttaaaaaatgccaatactaggggtctttctggaaaggagagagacccacagacagaacttcccctgtttgacctaggacttgcactaacctttgacctttggaggaaagatgttcagtcccacttatgataacaacctaataaataccaaacacttttcacatattcatttaaccctcaaaacaatcctatgaggttggctatcatatcattaccatttgattggtgaaaaaactgagagacgttaagtaacctccccaaggcctctcatctagtcaatggagaaagtgggatttgaactcaagaactgtctgacgtcgtagtcctggtgcttacctgccactctggactctttcccctttggccaaagcgatccaagttcctacacacttgctcctgaccctgtcaaagtccaaggccccaagctgtgcttcctgccatctgctcttgccttccccttgccaggcagaatgattggcttgcagagccagtgagatctcacccagagagagcgagctttgtcaccccgtggcttctggggtctgagcatctgctcggctctccgtccctggcccgcccttttcctttgcaagtgattcactgtgtcagtggtgtgtcagccccatactggcagcaggcatctcccagcgtatcatcagagacagaggaagagaaagacagaagagagcaatgagggcaatccgcctccctcagaaagatattgggagtcattttgaatgggcttgacaaaggactaggaacagctcaaaaggtgttctgcaagaggctatgggtgcagccctgggtggctggaagtgggagtcagggttttcccggcagctcacagcccccaggggcagagcagggcactggaaggcactgatcatatttccctgatgctcccctgaggttgtagtcaatagcaatgtagaaggacctttgctctccttgaaggtcaccaggagcttcccgttgctccaccttctggaattggccaagacactcaaagaacagcccttgctcaggacacatttctttcttttttttttttctttttagagggagtctcgctctgtctcccaggctggagtgcagtggcacaatctcagctcactgcaacctccacctcccagattccagcgtttctcccacctcagcctcctgagtagctgggattacaggcacctgccaccacgcccggctaattttttgtatttttagtggaaacggggtttcgccatgttggccaggctggtctcaaactcctgacctcaagtgatccgcacacctcggcctcccaaagcaccaggattacaggtgtgagccactgcacccagccctcaggacacatttctttttttctttttttctttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagcgaggatggtctcgatctcctgacctcgtgatccgcccgtctcggcctcccaaagtgctgggattacaggcgtgagccaccgcgcccggccgacacatttctttgtgttcttgataccatatgaatgagattattgcttaagtgaggctgatcatcagaagggactttgtcacaaccctaagccaaccaggaagaacatgttgtcgactctctgtggagtcaccccaatggggagatactgagaaagtgccaaagggttttccggacaggctatcttgcctcagagattctcagaccatgcggaaccatgctaaggctttgtggaaggagggaacgagtgagcagcacatttctgtgaaaatgcagtctttttgtcatatttgaaattcatgtgagattattttaattcttgaaacaggtttcttctcagctctaaattatgatctcagcatcaaattgaagcagtgtctttgttcccaagtgaaacgaaggccccgaggcagataataaactacataagtactgttaaccataggtagaatatttactgtacttaattttctacatttggaccatgaacaaaaaaatagagaaattttatcatctcccttcatctccaacctatgccctgaaaattttcttattattaatatttaaagcccatcactctgcatgaatcattggctataaaaagacataaattttgctctatttccattttatacacatatttctttaactcttccatatgatcaaggttctacattaaaaaaaaaatatatatatatatatatatatatatatgaaaacagtctgtgcttgtaatgcttcacccacgttgtcctaactgatttgttcagttgagagctccaggaggcttaaccagcagaacccaggggcctgccatgctcctttgtttctttctactgcctgctttctctccagtttgcccacaagtcatgccttaacctacatgcagtactatcctgctgccggggcacttttctttgccagtggcttcggttggctcatcttagtgacaatgggaacgataagatagaagtccctttcagtctgattctcctttatcaaggcaacaacctgaactctaagtctgttccagctgctaggggaggaaaacgttgactttggattttaaaaaccttgaggctgccccgtttaaatgcctcctttcccagtctaggtattttgcagcatggaaccagagagggctggtgcctcagtattgggtgaatacactggaaatcctgggttctcatgttgtttggttgattgagtgaacttgggcaattcactgggtcttagtttcatcaccgattgaaagggcggcttgtcacctaccttatctatgtcagagagtgattgggagagggaagcaatgagccagtgaatgtgaaagtgcttggttccatgaagcgctatgcaaatctaaggagatgctgtgatgatgaagattataatgatgatgatgttttcaagggtcattgaatgaatatatttcatatttccaggaaatatgttatttgattgttcatatgaaattgcattattagaatctgagtttgagtccagtccaaaaattgggaagtgctttttctcctagaactgccaatgattcaccagtggcactgtttggatgtggtcattaagatgccacatgtccccatctgtctactcctcccagtttaattttttaagtggcacagatcttctttaatctctttccaatagagaggtggggagggtgaagagagactgttggcaaagagcttcgagttcctctgcagaaggctgaggccatgggggtctaccacagggcctgggattggcattcattaccagaatctaagctcactggatgcaccacaccctcacacaaaacacctcccccttccctctgccagttcatggctttgtaaagcacagggaagtgtttgggctctgaggttagctacataggagttgaaatcccagctctgttaatttctacctgcttggtgtgggcaaagatctacatctctctcagcctcagttttctcatctgcaaaatggtgatattaagagtacctttctcatggaagtgcaaaaatcacttgcactttggaaaaaaaaatacatgcaaagagcacaatgcctgaaacatagtaagcacttgttgaatgtttgctgctattattattattgttatcatcatcatcatcatcatcaatattttcagaagctaggagcatttctatataacccactgacccagggggaaattgagatccaggagtattttggcctcatctctggggttgccctcataatgttagctaccaagtgctttgcagaaactccagaactgaaataggaggtgccatgctgtcatattttgctatttctgttctttaattaattctaactgtctaattgtatgggatgcctgttgagttgctcattttgcaagacatgaactctaggatgtctctactataaaggagcctgcatctcatctggtagggcacccaagagcttataaccagctgcaggtcaatgtggattgctcatgtgtggggctgaatgccaggaatgaggagttctggctgggaccggggtgggcagaagcagaggacacttagatcagaatttgtagaggaagtggctgtgaactgggtcagtagatatatagaacactatgtctaccttatattaactttccaacaaatggtagttactaatgttattatttaatggtttgctcgcaataggcattcaatatattttttggattgactgattgcctaaaactggcagtacaaacaaatgaggcaggttttattattcccatttctttttgcccagaacggcctctggtttatattgaactgggctcaatgctcatggtgatggaaccagtcataacaccacttgttgaattatcggctttattttccccttagatttgcagcccagcacattctatctaccttggcacagaagagagcaaacctttctatcagcttcctgtagtgtcatattaatcagtaccttttttcagagcctggtctcagggaagagaacttgaggcaaattgccaaaggacatgaaattctgatttttaccagttccattaagtatagcctttcattttgataaggtatttgtacccatgtctgaacttaacaactctattaattactaatatttatctagccctggctatgtgccaggcactgtgctaagtattttacacatatttcttcatttaaatctcataacaaccttagaatctttgtcaagtaggtgctattattttccctattattgatatgggaatactgaggcagagcgagggcaaataacttgcccagctgaggtcccaaagaacttgggaggtctcccaccatagcccatacccctgaccaacgtacctatggcctcactgtatgttgggcatcagatccatggtcagattgctcttgtcaaattcagagtgaagtacaggcatgttgggttgctggtttcaaggactgttcttgacaaataccctttgcatggtccggctgtcagtcccaggaaccctcttaagtccactgtagccaaacccttctatttagtaggtatgaggtctccggccttggctattaagtggagcctccacacactgactgtgggacaggccctttgaatctctgaactcctataacccttgtgacctatataaaattagcctcattactctctgcccccttaccctgctgcaccttcctttgtggctgccagtaccactagacaaatgacatatatttattggtttagttatccacattctgttgccctccccttagaatgttattgccatcaaacaagggctttgttttgtatccccagttcctagaacagtgtctggcacatagtaggttcctaataaatgttttgagaatctgataaatggacactgttgaggggaggctcattttcccagttttccagataggaaaccaaggctcaaagaagttaagccacttatttaaagttacacagctaataaggcttccatactgatcagctgatagataaccccttgggcccaaattctcttaatattttcagctccttgttcctaaaatacctggaatgtgacaacctgttcgatgggtgagtgcttccgttgctgcacctccttggcctgtcatatgtgctagcaaacttctgcacctatactcccctccctgacaccctccacctccattacccaaagatttttcactttccatctcatttctcattgatttattagcataagccatttttagctcactattataataaatctattaactcccagtgattacaatcagcattaattacatctaactttaaagtatcatacaatgcatggctgtagggaagactccactcttggatgtggcagcccctgacacctctgacagcagatgtctggatacctctttgaaagacgcccatgggctttagcatgttggagttagagtcatagcgtgcttactccaaactagagaattggcttttcggtctgactgaccagggttccaactaatttttcccctttctagccatgtgtgctcaggcaagtcacctcatctcttggagccatagcttcctattttcaccatgttactgggaaattaagaaatggcagccatgctgatgtctcacccagcctctctccaggacgtgatagggggtgatggatccctgtgttgagtgcaggctacctcctgtcctattcttggagctattttagatgtacacctggaaatatttatgacatcacttattctataatacatttcccctttatgtatggaaattagggaactatgttcatccagcatagttaacagggttgtcctttaacatttattgggtccttactaaatgcctggataggtgaagaatcaggctaaagtccatggtaaccaagaagagttagccagtctttcaattatggtgctcttctctacatctaataaagctcattccttatttgcattattaagtcctcttgctttgatgagaagtgggaagcattggctaactgtgatcccctagcatggaatggaagactttagggcatatagatgctgtcattagtggctatattaaaagaagaacctgtcacttaaatcagtaattatcatgggggttaaaagtattaacagcaaagttcttgagttagctaaccactgttttttttcttttttactttactagaattatttttagttaacatttactgagaacttataccatgccaagggctttacgtaagtattttatttaaccccaacaatagtctgatgagggagttactgttattaaccctatttatagataaggaaacaaatacttagtttaagaggcatgaccaagatggcattagttaacagagcagcagaaatgatgcttttgactgagacatgctcctcattgtgataaacactgttgccttttcttagtcaagaggaataaaagcatggagtcacaacaacttccttccctgttaagccttattcttgggttgcagagaatcactagcgagagacagagaggcaataggcaaaccttgatcttcagaagagctgcacgaatctacaggaagaaataactgtgagtgggtggagtggggagaaagaggagggagagttaggttcaagaaatgcttcaagggagtggtggggattgagctggttcctgggaggtgtagggttgggcaggtgggttgtcggcatcaaagcaaatgtcttgggctggagcacaggtgtggcagaggtggaaatgtagattgtgtatttggggaacagcagacgtgtacttttactcaattgctggtaggagatgtggttagtgaaataattagatgaccacggtctttgaatgtcaaacccaatttgtacatgtttatgaatgaagacacacctaaatggtattagagagtaaatttgatgaaaattctgcaacagacccatggaaaatattatatatgctctcttatcatattgtttcctaagttttcttaaaattatagtttgtggcagggagtatattgtaggatgagtacaggccttgggatggattacatggtcttggattggaattccaatttcaccatttattagctgagggacagttggcaggttaataaaatagttctgagcctcaatttctttgtctgtaaaatggaagtgatcattgcaagtttgcaaagattaaatgagctaattatttataaattgcttgggggcaattttggctatggtatatactcatcaaatagtagttctattaaattagaaagcacaggaaagcatagcctgatccctgagtggattttccacaaatactatctgatttatttgtgtgtgtgagtgtgtgtatactactcagctatgctttctatacaaacacacacacacatacacacacacacacacacacacacacacacggtatatattgattactcaatctacctagctaaactttaaaaagatacatgtctaatatctgaagtagaaaacattccatatataaatatgctgtgagcccaggccaagatgggaatggtacctaggcccattagaagtcatccatttttaaaatagatgtcatttattagcttaaggattgtaatgtggtgattttgagaagcatcttgttggaatcccacctgtaaaagtctagttttcccctatagcctgggacacacgtgcctttgaattcatgccaacaatagggaaggacagtgaagaaaaccctgatattatattgacactttctttacttctctttggaagttctcctgtttatattcttggtgcttaactgcattaaaaaaaattcaggggcaaattgttggtttaatgaatgcctgtgccttcaacaaagatactattatgtgaaaatagtcaatagcccattcagagtttcccaacagatatgtttctaaaattgttgagtgtgaagttttgcatctatgagcgtcaggagcacaatgccaagtgtgtgcctagcaaaacttcttcactgtctaatgctttcctatagctttctctggcagatgcagagatgcataatcattgattctgaaccatcttcgattagcagaaacttctaacacttcaagtttctctgctcccaacctctctttcaattggttaatgatcttaaaataccctcagctgcaccacagtgtctttaaagggcctgctatttaaaggcaccttgggaggaatcccctgattcacacatttgcatattaggccaatgttctgagtgtgtttgggaactcagcagtttcagataatattgacaacagcctcttggccagggttgacattattcagataaggcttgctacatactgaccttttacatatatcattttgcttagcttaaatgcttaggtcagtgtcaggatcagctaattaatattagctgttagtgaaccccataaacacacacaccattctgaagtggacactttaaaattacatgaattttaaattccattataaaacactgtggggtttttaatagatcaccaacaaacaatattgttaagcaattaaaaaataataaagcaaacctgcttaaatagctgtaacctcacagggtcaaaattatgcctgctgccctgggaacataaactcttgaaaactaggggaaataaactgttaaggacttaaaatagactaggcatactatgtaagtattcgaagcatcacttccatgcctcttgcatgcggtccatttgagcaggagacaagacttgcttttctgtctcttcagcaccaccttgcactgcattctcagctccagggttgcttctgtgcatcttctatcaggcacagaggaaaagcaatttctacacacctcaccagatcttaaaatatatccttctctgattcctcatttgcccttgacactgctggcatttcatttcgtcagtgttgtagggtagtgggaggttacggttgaccttacaggaggaacttgaagcctcacagagataaggtgacaccttcccgattgcacacagttgtatttacagcagtgctggggtaagagcttggattagaactcaggacccttgtggcatccatctgttgctcttgccttccaggataaatctcctttcctggtaagatggtttgacttttacaagatcttgattttcattttaataatcccaagtcttcccctgactctgcaaaggagttaaatttaaatacatagcctacattttatcttgacattttctttagaatgcaggaaaaggaggggccagatattcagtcttcccatcatgagagcaaaatcctactattgtgttggaaccctttgttaagagaggtgtggggccaaaggcttctttgcaagcctccaggctctccagttacccctgcagacaccaggaaaaacctgcatcccacattctacatctctgtggggaatgtacctgtgtcagcattaagtgatggggctcaaagatagtcttgtcagtctaattgctcttgagtcattgcctctcctgtcagagctgtctgtctccttacccataatcctcatcactttgatagcccgtcaggaatatgggactttgcccagccttgccttcatccaataacgttatgaaattgatactgacacttccattggcactaatttctctaagagattggagccagaggacaagtggtttagcttcatggcagttaagctttccaagtagatcaagatggcctaagattgattgacctataccctgaggaaggaggcagggagaagtgaacagagggagaagagggagtggaaaatcaatggctgcgtcgttgtcatcaaatgatatttattgactgcctaagaaggacaatgtcctatatggatattctgaggatacttgctaggcccctctatagactgcctcaaagggagtttaggagataggatggagacatgttggctagggtggttcactgctttacttgtgatattgcatcactagtgtctggagttcaaaacagcagttgattctacccatgactatcttttctccaccttccactcccacacacaggaggcctaagttactttttatcaggcttactacaccatttttcatccagaccaaagggggctctattaatgatgatgctggaacaacagataaacagactgtccagggcagatcaggatgtgtggtcgccctccttttaatagaaccagacatctctgaactgaatgaggagatactccctttttggcaggcttcaatttcttacctgaaccattgttaggttaatggatgcatgaagaaacagacttttgatgaggaggtaccgtgaaggtgaggagttttaatgaattggctagtttaataatataacctgatctagacatcagtacaagaataatactataaactgattgtgagaagtcacaaaatttcaaaataatatgcatttatacattttcagatgagatctctggactttttttttcccttggtaccagggctaactcactactatagaatctccccaccatctacctcaccgcacctttttggggtattctgtttgggtgttcaatattcctgggtatattacacataagtatattatatacatcactcatggaaatattttatctggtgagatggaagaaggtgtaaaattgtgaagaaatgcagaccagtaattctccttacacacctgttcaatgagcagccacgtgctactagttcatgtgtgttcatacacattcttgttcagggagtgcacatgggatttccggtatgtttatgagggtctgctggtgggcatgcgtggaacctcattgcttttccctgtgtgactgaaggggcttagagtacatggccctgtgggtgtcagctgtcagcctcgcccatggagcctctgcagggcggtcagggcaggcacgtagacaggagcaggtactacagtatataaagcgtgccgtacaagggaagagatcacagaactgatgcggtgttatttcaattgattttggtgttgcatttatacctgcacatgctgaaaatcaatcgaccctctgtaccctcgccattcctgctgcagcgctgttcgaatgaaatgcttatatcatttttatggcatgtctgtgaaagggatgagtgagccaagagattaatagaggctgctggggcccttgcccggctgctgtccaggtgtgtggggagaagagacagcagccaaggttcaaggtgccatgaaggtgaccccccctgagaaaacggagaggatctgtggaacaggaggctagacaagtcctctggggtgggacaaggatgaagtatgtgggcagatggagctacaggctaatgtgtttgctgggtgaggtgtccttccttgcactgccttcctctctgtcctcccctggttgactgtctcaggtgctgcctcatgtcctgagcgcacctgtaacatggtgctcttcctatgtgtcatctctgttggtttatttgtgtgtcccacctgtagacctggggacctgttcaggctgaggttgtgtcttttttctccccttttctagtccctagctcagagcccagcacaggagaaggtatttggtgagcacatgggcaggaaaggccagtctggaaggtgtggcatgaatcatgaactatagtctgtaggtcactttcaaggattctagagggtacatattgctacagttcctggggagctgctcttgggagattaaatgcccatagattgaactcccagttcacccagagcctgagattcctccacatctatcaccatccttataatgctggtttatcccttgtgcctgccactgatgctccagcctgggtgctgaagattaggcatatgggagacatggtgctgtgggttgaattgtgtcctgcaaaaagatatgttgaagtcttaatcactagtacctgttaatgtgaacttattcggaaatagcctctttgcagatggaattaagatttaagttaagatgaagtgatacaggaatagagtgcgcccttgatctaatttgactgagggccttataaaaagaggagaagagacacagaaatggacacacacaaagaggaagatgccatgcgatgagcggagaaggctacatgatgacagaggtcagagtgatgcattaacatgccaaggaatgacaaggattggcagccaccaacagaagcttggtggaggcaaggagggattctatccagagtctcagggaccatggcctggctggtaccttgatttccaactgctagcctccagaactgtagtgcataactctgttgttttaagtcacctagtttgtgttttgttgtggttgttatggcagctctaggaagttcacagctttggagaggcaatgcctaccagtgtctggggtagcacttggggcaacgtatattttgtaattgcctgttctcttaaagggactttaatagggacgcagtgaaattcagagatatccaggatagagtccttgccttgtagggatttatgatctagagaattttaggaccagctgagaagcttgaattgggataagtaaggaaatgggccagtgttgaccccaggacaatcaacagcaggatgggttcaaatgcagacaggttccttactgctttttatgggtgtatgtttctgatgaaaattataacactgggtaatggcacaacttccagaagtaaaatgccataggactgctctgtgacttgtccacaagatatccttgccacagacacagggtggtgggctcctgttataggtcctgagacttggatgtactattctagttggaggcaacactgtgactcaacagagagctgggcctgggagatgtgctacctaagatgggcaggtgccaacacctggtccagtgagcactaggcaagaggctacaggaggccagaagcacctgcaatagtccatcccctatgcaaaggtagggcctgtggtcccgcagggcatgcacagcccccagcagaagtaccttcagggcttgtggaactcagcatggtgctacagcaaatattttctaataaaagggaaagtacctctttgtctgatataagatgatagggtctgtgtcaagcccagggtgagctgagtgtgagcacacaggattcttagggcatgggattgagttcataatctcagaatggcctggaagaagacattggactttcatggtttctagctaactgtaaattcaggcctcatttcagcatctttgatttaggtgcattatagttcagaagtgtgttcattctagacctagtgcttttggccgtatgattatgtaggttgaggtggtggtggggtgggggggcgggtgtggtgggccaggcgtggtggctcactcctgtaatcccagcactttggaaggccaaggcgggcagatcacgaggtcaggagatcaagaccatcctggccaacacagtgaaaccctgtctctactaaaaatacaaaaaaattagccgggtatggtggcaggtgcctttagtcccagctactcgggaagctgaggcaggagaatggagtgaacccgggaggcagagcttgcagtgagccgagatcgtgtcactgcactccagcttgggcaacagagcaagactccatctcaaaaaaaaaaaaaaaaaaaaaaaagaacatagacttgggaatcccacagctccaggacactgctacctactagctgtgtgaccttaggcagactgcttaactgctctgactctaattataggacccacttcactgagccactgtgagcgttggacaggatcacacagagcccagtacagtgccaacaagtgaccagtgttggtcaacaagtgatagcagaccttagctattattatctgttttactacacaggtatttcagatcatcactctgacttttctgggggtgacaatatgccatggtatgactccatgtgtacttagaaatactgggaaaagggttttcttgagacataccctggataccctattgcagtgtatgagacccatacaactgtgggtgacatatctagttaggaagtcttatatcagccagtgcctataagaccccaagttcctccagaaaaggattttcttcttctctgcatcagttctctctctctttctcttctaactcattgtgcctcactttaatttgaaagaacttcatattgaagccatccaggatcacctagtggggttttagatattagatttccctcttgtgacctccgtaaagtcagaggcatttgggcttagccctcaggaatttgggttctcattctcttggctttggtgttgaaatcagatcatgcaagtgccaaaagggacatgatgtgagtgggtggaggcatgaggactgtagcagttcaacatggcagcccctggcactgcatgacctcaagtgatgtttcctcccagtcttcaaaagtccccaggaagttgggggaaagttacagataaatctttagggaaaataaatgtctctattttgaggtaacactagcaagccatagtggctagaactgaatttagacatgttgaaatttgaactatgatctcttcatggggcctcgggccaaaaacccagcattttgtattccagtcaccttatacgtgcaatcagaaggtaactactcacttcctgttgatgcctgggatggtctgaaatactgtctgtacaaagagtctttggagaagtctgatggcatctgccttccctccaggatgcttgttttgacattctcagaccccttgctgccggccattcctgtgctatgaatttctggttgcccctgacagctacatccttatgccacagttgtgggtttggagtttactggaaatgtcatgggcttctttcctaaacaaagccagttctcttacaaatgaatttcaagagagtaaaggttgggagtgggaaggagaatgtggctgacttgtcctgttgttagaaaaacaatactggagggtggggcagcaaggtgctgcagtgaaatgagcccagactttgaagtcagatagacgtggatctgtttaccatttattaactgtgtgatcttgggcaaattatgaagccttgagcttgaatttcctcaactacatcactggggataagaggatctacccccagggttgtggtgatgattaagggaggtaagggaagctgagtccaaatacccatcctgccttccccttccttaagtgcgtgttcttgggctggttgatgagcaacatcattttcaatcaccaagtgatacctccaagctatgaatgctgcgaggcatgaacaacgcctttggttcctgtaagaggctgggagggaattcgagccagagaataaagcttatcttttgggaaatgattcagggagaggagcggagaagtgcggagggcaggccttgctgtgctgcctgcaggaccccatgtgccccggagaccacagagggcagagtctgtctggaagccggaggaggcagagaggggagggcccagaggaacaagtctaggaacagaaggccatgactagtccccaggtctgttcttgagcacagcccgtgttcacttggcctctgtcccacatctgccaataaaaattaagaaattgattttcttttgtttgcctctgaggaccagcctctttttatgagacagtaaatggaatccctctctgagcatggctggatttttaattgtgtttgttgtgcttccacttattccgttttatgagttcctgctcccagatttgttgatgcgaagctctcgcccaccagggacatgtcagtgtttgatttctatcagtaggaaaaggttgaggttttaaaaaaatcattttcttaatccaaaggttggcttgtttgcttcattctgacacattaaaaaaagcatgagacccatgcaggcttatttgcttctgctacccaagtcagatctaagtggtcatgatctgactctgtggaacagaagattgaagatttgagctcaactttgggacagagagtggggaggaggcattttaaaaatggattatatcattgaggacgacaagcccttttttttttttttttttttttttatgagggacttctgcggagacttgctgaagatggtgtgatgcacgcgaagtgtctgaatgaagaaattaaagtaccattggtaaatgtggagatgtgatagacagcacccccaccaatcacaactgcttaaaacaatggtgctgcattttgcacgtcaccatggctgcgccaggtgttggcgggagcccttgcgtctaagttggcctcactgagggactggggctgagtggggttctgtttcatgcttccacaaatgccaacccaggaaaaagggaatgtgacaagtcacactggatcttcaagcttccacgtgggagtgatgcatcctcacttctgcttacttttcattccaaagaaagtgatgggggtactgtttaacttcaaggtggtccacaaaactgcagtcctagtgagtgcctagatatactcaataaatagcagtcatgcttaccacagctcccaagagggcttctgagttgggaagtgagattgctgccccccaaccctactttggaaggaagtacaagtgtaaaggaaggagtacaggaatcgattctggagttggaattgtacaatttaagtctatctgttggacttgtcagcccagagctattttatgtgggctggtccaaccctgaaaatatttggcagtccatccctagatgcactgatttagccccaatcacaggggagctggcatatcgccttctgtatataggctcatgtattcacaccaagcactctttgtttgtgaaaaatacttggtgtcagccatactgttgagaaaatgggtagtttggtgtgaagacgcagaactttggagtcaaacaaaatggcttgaaatacaggttccaccacttcctgactaggtgatttttgaaaatgacttaaacttatttgaggataggttttgttgttgattaaatgagaataatggtagttgttgaggatcaaatgagatgagaagaaagtgcccagcaacatatctggcatgtagttggtatttaattaatgtcagttttattttccctccatctttccttttcttgtaaaccacagggatcccagcatccttggggttctgtcactcctttggaatttggagaagaaccacttctacacgttggctgggcaaatgccctagggttgggccagtggctggattttcttggtgccacatttctgagaattgtcaatgatctgtaagtcatagagttgctggaagagaaaggagttttagagccaacagtagggcattagagaaaataattccaaggcagtctttcccctgatctgaaagagggagtgagtattgatgtatcagtgtattccctgggaggccgctcctttttcctccttcattttttgtgacccacctctttccccctctctttctgcattatgaaccctgagaagaactttccctggagtcaccaaaggcttctgcagaatggtggtgtacccacaggtcctcatggtgacttgttgtcccaggctcctctcttgggactggggctcagcccacctgggtggaagttcatgctactgcagtgaagttccctctccactgttgccatcagaaagttttgctttctctgtgtaaaaagtaaaatagagattcctcttcaaagactttcctccccatctaattaggaataaatagtaacttctcttagaagcaaaatttattcaaagacctgtgctaacattcttaaatatctgctagccataataaagaaatcaatgtactttatgttcttagctcccacaatttagcctaaatatttgccctggcatgcttatactggtccaagcaagcattaggtcatagcctgttcatcttccttatttgaaggtgttgttacctttctcagcatttcacaatttacttcctccttccttggttctcctctgcttttcctcttttaaaaagttctaagttgctagccaatcatgacaaatatagaatgtgaggtcccattccagccaatggaaaccggacacagcagtagggtggacgtgtcaggttataaatgaccctgtctcctttgttcaatgtattgtcgtggcaaaactgctggtgggtgtatcttttctgcagaaagtataaaaacggccttgctgaggaaattaaatttatgttcaagtgctatttctttacggcactggggaacaagcatttcaaacatctgggaacctgaatcccaacttggaataaaccatttatggaattggagccattccttgctctacaccctcatttttcccctgtggaagaacagggaggggaggaaaagcctctggacagagaatatggaccattctgtggggaaagacacctgtcagggccatcgagtttctccagttatccaatggttctgttatgatatggttggaagaataaaatccaccgtggatctgaagaaaaaaacaaggcaccaattttagaagagaataatatgatattgagagtctgtgcagacctctgttcccttgagggtctctctccaaagcttgcatttactagaaaggctatgagaatgtttctcttctttttgattattagtgttgcataacaaagtaattgtgtaatttggaatggattagtgacagcagagaggccgataacaggtaataggcgggctgtgtgtttctgtgcgtgtgtgtgtgtgtgtgtgtgtgtgtgtgtgtgtgtgtgtgtgtgttgagggctcaatagacatcaaagcttgactcctcttgacctgccatccacctcagcagcttcaagaaaatagaagaaagctgcccagacagttgagatatttttccccctattacttttccctccttcactatcttaacaaattcttcactgtggttattaaggtgagaacaatctcagtgagaacaaatgcttcctcccctagaggggctacaggtctttgagttttcccctgaggcaagtgatgtgagaactggccagagtttcatggagtaacatgttggtgtctctctcagtggttctcaacctggcacagctccgtcaccacaggggatgtttggaaatgtgtgtgtgtgttttgtggggagactggactttttttttacattttaaaatttttgtcttttagactttatttttagagtgattttaggttcacagcaaaatcaagtaaaaggtacagagatttcccatctaccccatgcccctacccatgcacagcctccctcatgatcagcatcctccgcagagtggtgcatttgttatggctgatgaagctgagactggcttttcatgcccaggtctagggctgctacatgcctagaacagccctgtccaaggaagacttgtcttgacccagtgccagccgtagccctataaggagccctgctggactcagacacaagcaggcaggggccagttgcagaggcttcctcttacatcctttgaagtgatgggcctatgtgctttttattgggttttcttttaaggaatgtagtttatggaagagcaaaggtgagtaagagggccttgggaatggggcaagagtctgatggtgcgatgctcttttccgctgtggatatagcttaataggaacattcagcagtgacatacatcagaagacatgatgaattatctgtaatctatctgggtgagtctaatgaggtgactcactcccatcccaattctcaagggtcaagaggaacatctttaaaaagggtcttggggagctgcaattgaaggcagctgcttatgaggaagataatgtaccagaattgatcaagtatccctttgcataaattctttcccccacagtctgcactttcagggaggcagtgctggtggagggttatgagcacaggctccggagccagactgtgagtttaaattccagcatcaccacttctttgctaggcatctgtccttgggcaggtcactgctctgtgctgtaatgcccccgtctttaaaatggggaaaataatggtaccaatgtcacagaggcattataagattaactcctttacagagcctgatgtgtaggaagtattcaataataaaaattattacaatcatcagcatttctccaactaactcctcaactcactataatttgacttttccttaacattccatggaaacttctctcattaaggtcgcctacacattttccaacacgttggctcattttcaagcttaatcctgtttgtcctcagtgtatttgtctcttgaacttctagacactctccttctttgaatgctttctttctttctttcttttgagagggagtcttgctctgttgccaggctagagtgcagtgggtgccatctcagctcactgcaatctccgactaccaggttcaagtgattctcctgcctcagcctctctagtagctgggatcacaggcatgcaccaacacacccagctaatttttgtatttttagtattgactgggtttcaccttgttggccaggctggtctcgaatgcctgacctcacatgatctgctcacctcggcctcccaaagtgctgggattacaagcataaaccactgcgcctggcctcctcctttgaattctaagacagtatccttttctggtttcctttcacatctctggcagttctctttttccttgctccccttctaatgcccacattttaagtattggggtccccagggctctgatgtctggctttattcttttatctctctcaggtcttcctgggtgatcttattccttcctgtggcttgggagtctgtggcagaacacttccatctatgcaccttaacacagctttttcaaatcctcaaataaggtagagaaggtggagactgttttagatcccaggctcttggaacatttcattgactacttgctatctatggactttatgtgagcagattcaaagaaacagcctttcacaaaaggtttaagtctcgatgtggtatcttctcaaacttctccctcttccgtgtccttcctccatgtcactttaaccatccacatcctataatgctgagaacagaaaggggcggggttggaggtgaacttctgttgcgtgtggtctttgtgtcttcctgcattccgtggtctacaattctaataaagcaagtagtctgtagttgcaggaaggcttgtgagctttggagtaaacaagacagcctgggcatggatcctgtcttcatcattgtattctgtaatctctcgctccagacacctccttcccgcagccctgcggcttgagactgcctctctatgatactaaatccccagcttcctcttttccttgcttgcccccttgttttgctgacatccctcttcctgatgcatgctaagacggggacaagcaaggcaaatttttacacatttgcaaatacttttattttgttcttagagtggattgattttttttttttttaggtgtagatttccaggttaaaaagttccccatccaaatgttgaaggaattgctctgtagaataacaatagtggtattgttatagagaatgattccattgtctttctgattgctgttcctttataaatgtatccctcttgcctggaagctcttagcatcttctctttatctctagggctctggcattttgtaattgtgtgccttgatatacgtgtgtgtgtgtatgtgcgtgtatgtgcacatacattcatagttgtgcacttgtgttaattgtgctggaaactgggtaagtaatttgggtgaaatttccaaaagtttttcagttttccattcatctcttctgttcatattcattttccctgtctctctctctctgggatttcttttaattagatggtggatctctttatcaaacctttgattttcttatctttccttttttatttaccacctctttcctctttgtttaattttctggaagatttcttggctttatcttccactctcctttaactttaaaattttgacgatcgtaatttccaaggactcttcactacccttgaattgttcacgttttaaatattgccttgcttgtatagatgcagtgttttcactgacatctctgaggatattagtagttttttttgtttagaaagtcttcttctgcttcctgcattgcctctgtttcctgcaggtcgctgattgtctacttgtcttgtgctctcccatgccggagctttgctgaagtgcctggtgatcttgactgcttcttcatatttaggaattgagccctagaaagctagtgcgattctgccttgtgtgcgtgggtagggcttgccaactggcaggtttcactgtggcatgatcacagaatgagcttgactttccactggtagatctccaaatgtccataccgagaggtattttttgagagaattcatccagagatgtattctctaatctcctgcagggtgctggtatgagatgagattggtgtgatggggaggcagggttgcaggaagaaggggctgagcttcatgcttcatcccagccctctcctgagccttctgagttcaatgtctctgggtaaaccactagagtcctgtgggaagggagcaaggtgatagtgggggcggggcaccttgttcccgcctggagcctcactccacctcagccttcctggctctcttgtcctttcacatagtgatcctttccagcagaactggctgcctgcaaatattccccctgcagtcctgttggtcatctcttcttcaactctttcctctttcctcctcttgcctctttcttcttttgactttttaaattccaaaatattattgaactatcttattttctcttatcaccacttttcctctttctctttgtgcacagatattttttgaatttccttttttgtattttagtagagggaatggttagtgtatgtttgaggagggaaagaggataaaaaccagtgcttagttttccctgtttaactggaatttgctataaagtttttcaaaaagtttacaaggtgttttcaggaactggcttcttttttgcaaggcaagtgattattgtgagtatttgggcaaccacttacagctacttttccatacggtctccaaacacagtcagatatttgtcatggattggaataagcctgtctgtgctgatggagtggaattcagggtcctccatttgcatttaccagtctcccatttagttctgcctcattggtgcttcacctcgctatttgatgggaaatattctctccataaacttcagtaagatgtaatggatttctgcagtggaaatattgttcaagctgcaaaaccaaatcacagcaggcactttgtctggggcctgtgtgtctagcaaagcagccattcaaaacgccagttgtatgaagccacaaacagtcacagctaattcactttacaggagttttatttgtatgtatgggagaaccacggcaccaaacagaagcattcttctaccaagactgcagcgttaattatctttgccatcttgggctttttgagtaactgtatgtccttactggatttcttctttgggttagaaagaagtgggagtggaactggggttgatgaagacacaaatgatgttctttgaagccattgggtcaatgtgatatttcaagagtggggcagctggcccagctgctggtatggagatcatgatgcagcttcgttactgtcatttgtaaaacttggctcagcttaggtccaggcccacagtggacttacctccctgtgaacaagggagggttgatggctgagtgcagtaaaagatagaggatactcccctgggagtctggtggccagctggagaggctctaggtctttgagccactcatcagagtttcttgatcctgattgtaaatgggactcacctggggagctctcacaatctgatgtccagcttgcacccccagaccaatggaatcagaacctctggggatgaaatccagcatcagacattgttaaagctccctagaagaggaggtacagggtgcacactactgctaggtcatttttaaaatcctattgttgctacataagaaaataaacgtatttaaaactcttattttgaactaatttggacttgggagaaagtgaaaatagtttatgccagggtcatttaaatttaccttgattttccagctgtttccatggtttgataggtgagtaattctcaagaaagagaatttagggtggttctctgaattcagaatacagagcattcgaggaatacgcttccagtggattttgctaataaagaaaatgtgggccgggcatgatgactcacacctgtaatcctagcactttgggaggctgaggtgggtggatcacttgaggtcaggagtttgagaccatcctggccaacatggtaaaatcctgtctccacgaaaaatacaaaaattagccaggcatggtggcaggcacctgtaatcccagctactcgagaggctgaggcatgagaatcgcttgagtccaggaggtagaggttgcagtgagccaagatggcgccactgccctccagcctgggtgatggagagagactctatttcatttaaaagaaaaaaaaaaggcaacctatagaatggaaaaaaaattgtaagccatgtatatctgataaggggttaatatctaaaatacaccagaaacccaaacaactgaatttatatatatatatatatatatatatatatatatatatataacacaccccccaaaagtaaaaaaaagaaaatgtttgtgatgggaacagtagttgggggttgtctgtggacagggctggaaactggccggatgtgacgtcaccaggtcctgcgtctctcttggtgtgtgcaggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgtaagtactgggatggaatgctctccctcctggggaggggagggtggttggtgatagaccatgtacctggggttctggaaccttctagggtgacctgctacctgccaacctcccactttctaagagaccctccctgtttgtttcaaaacttgaagaatagcctgagccaggagtccccgggaccagagtcctctgcgaagggggtcctgtgggtctgaatctgcttcccttttttcttcacctgggctcagcaggaccctgggtgctcccaataaggcaggagacacagagaggctgttcttctctctagacctggcctatgtaactaggaaacataacctgactctgtttagacagcagcccctgagctcaccagaacctccacccaagcctccatgagggggaagggaataaagggcagtgagtacctttgaatggaaacatctctctagctgcccctccagtgccccgaagtgtgcactttctgagaatcagatcacagccccagcgctaggaactctcacctccccactgcagatgtctcactcagaccagagggctcagggcacctgtttccctctcatctcccctctcctgttggttccaacccctctccttgtccttctgctgagccctgctaggccccctctgagctcctggagcctcaatgacttgtctgtccatccagcagggttcctcctgctgtgtgcccaggttcaatctgggcccagcaacacccaagcagacccccgctcctcctactcttcctgtccccaggaaatgatccactgcatcaagagagagcacagcagctcctggagaacagggacacccatgcctgcctgagagctggaaggacagaagtgatcggctaggttgaggcctcaccttacagacaggaataccgaggctctgggtggctgccccaggcttcctgacagtgggttcttttcatgtctcagtgggttgcagggtgggcctaggaagaggcgctttttggtcttgctcagcccctgggcagagctctctgtacttggagtacagtctttgtagctcacagaactcttgctgctcctgctggttcatcctacagcagagtgggcactgggctacccccatcagcctttgcttcatttccctggctctgagttttaggagagcattgccacagtgggagggagtgggcttgagtcagcataaggtcatcgtttgcctcctaaccttgggtgttctccagaatctgtctcagtgtgtatcagatgctccctgtcagtatcagaaaaaggacatctgggttctgaaccacggctgggcaaggaagagagatacctgtttttcagataaaccatgggaagcacagaacaaagattagttcacttctggctaaatttcctgtctcagatcaggctcaccccaggactggcctgggtaggactgggaggaaggaccttctatggtgatagctgggtccaagctcagtctagggttgatactgagtttcctagggtgctgttgatatttgagcagagacctagacattgctatgttcaatatacagttggttctcattatctgtatcagttgtgttctgtgaagtcgccgtgaacactgaattagtgaacactgaaccattgctcctagggaagacacgaggttaggttcctgtgagcctcgggtcacattttatcaaccagtcaatacataaccttgtcatatgtttctgtttaaagacaccttatttaatacatgttgttgattcattaacattgaactcatggccatggccactgtcactcttcctgagcaaagcttatctaacacatgtgttttttctgtgaggcacatcacagctgtcctaagctaaggaacactagccaatacttcagaacgatgcttgggggccctaccaaactgcatagtcactagcaacaagcacaaaagtgtaaaaaaatgtggtctggaatagaccacaaaaaaggtagttgtttatagtatgagagttgaaacaagaattttagaacaatgtacatgataaatatgacagatgacaggttttttttttccaattaaaataaatgatttttttttaaaaaggaagaaggcagatatctccttgttgagtctcagctggaaacgtgcctctaaggtcacattttgtcactctacacatggccctaaatgaccaggaaagtgccttgagtcttggttttggcactgcacataaattttagaaagtaagtgaattcccaaatacagaatctgtgaataatgaggatccctctgtcctctttagtggaagctctggattcctggtgcagaatatgatctcgtgatcatatctgctcacagaagctcctgataccaggttatccgcacagttgccagatgggatgactctctggtgtgttggaggcaagtttcctctgggccttcagaataagtgtccccatggaagcctgggagccatggagagagctatggggcctggtgaacatcctttggtgtcaaaacaaagcatagccaaggactcatcccactaggcaaaccatgtggaggaagtcttccttctagagccctctagatttgtgattcaaagtggctattctcaggatccagacggttcttcagtgtaaacaagaaaaggttggtgaaaatgggaaggcagcaggtttactgatgagacttgaaggagcaggggaaaacaaacaatgccttatcagaggaaaatcatgagatgactccagatcatcagaaccctctgatgctggggaaagtagcccttttaaagaagtgggactttctgttccatcagtagacagcaaatggctcctaattgttttcagaaaacatgagtggcatgacagacaatgagcaggagcattgtagctgcatttgtctaatcctccctctgctaatcctttggtgactcacacagacagggtgaaaggggacccaggccagtcctcagcagagatttactggctgagccagcagcaggtctctgattaaccaagccttcatcagtcgagggaacagactccaagacacatccctgtgtgcgatgagccactatcataaataattaaagccacatgcatcttggcatataaataagtggagagtatttatggtgtggcagataaggccagggtcactcctttagggggatggcaagaaccaggaaggttaagagaataaaaatgctcacattgtgaatcccccagggggtctcctcattctgattcccttctttgtcccatttaaaaatgtgtaatgtggggtggaattgcatgaacataatgctacctgacttcaccccttatttccccatccccccagtgatggattaagcacaaatgtgcttttctttctgtacttatgtatttattataaacagtgggatctttctgatggaaatgattaggatgctggtcctctccttgcttctcactttctatctgctttcaatctggtccatagcatttttcctagcatgtcaggctgcaaggatatttagagatcacctggtacaatcccttatcagatgcttgcatccccacacctatgttcccagcaagggctctgcatttgacattgtctttattctgcatttatttagcctttccagggattccgaaagagcggaataaagatgctcctagtttgcaatgtatacagaacccaaagcctaataaagcccccctcattatttttgtatagccctctggttcttgagagcatcaggaaatggatacagccctcctggtcacacagctgaggaccctagactttgggccaggtccgatagaatgagaagtcaagggaccagtccagatgggtcacttgggagaagctaaaagttatttgtagcaacattggaccctcagttacctttgtcacccatgtggcagctctggactgcagtaagttgttcatggatgagggctggactgcttgctgctttctcaggagtcacacattggccttttcccataagccagttgaaaggcttcttggttaatcttaaggatgaacagggttctctgttcatccttttctccccacacccatactcttggttgagaaaacagagaccatctggggagaggcaactgcctctgccccgtccttctgtccttgggtgtccttgtcagcctttgctcccatgttgtccctgtctcagaggaagcagcgtctccatcttcccagagtcatcccctcccagccttcccagtctgggtctgcaaagatggcctgtctccatcctggttggcccgccctttcctctcttctcccccttgaggtagtgtctgtctgctcctctgcccatcgccacacctcttgtaggtctctgtcctgaaggtccatctgtttcttttccccaggagcccctccactctccatccaagatcactttgcaaaacctgaccatgttcctttgagcttcctttcctccttagcatccgagtcactttccactgtgctgatttttccccttttgtctatttaatccatgtttattgagggtttgtgtcagcctttcttttaggcactggaaacactggggaacaagagacacatggtctccaccctcatgggctcacgtccaaccatagctgaacaccaagacatgggatggcgccccctgctgcaggaccactgagagcaccttgtgccctccctccctcccttcctgtcttgctctcttcttcagctttctgctgatgactcaccagcctttattccttctttccagatcatcattcccacacctccagccactaccttgaaatgcccattttccctcctcaccctcactccctctcctttccttccacaccctgttcgtcttttaacacctctttcatttctcgcttcttgtgaattcttcctagccccatgctatcgcaatgggacctttccttccttccttctaacccatagcttagtcagtgccatgccccagtcttgaatgactttgagccaaatcataggtcagcctgccgtttctcaaatatacatgtcctgtttcccaaacccgactttgagtttattcctagtgtcataattctttattttcaacagaaaccacagcatggaactagggtcaaagaaggtgctaactaagatgtgtcagatgactccacgcccaggctctctagaaactcagagaggggccaggcacggtggctcacgcctgtaatcccagcactttgggaggccgaggcggggggatcacgaggtccagagatcgagaccatcctggctaacacggtgaaaccccgtctctactaaaaatacaaaaaattagccgggcatggtggcaggtgcctgtagtcccagctactcgggaggctgaggcaggagaatgtcatgaacccgagaggcggagcttgcagtgagccgaggttgcgccactgcactgcagcctgggcgacagagcgagactctgtctcaaaagaaaaagaaaaagaaactcacagagaggaaaaggaaaatactattgatttgtatcaacagcctctttagagcaagcactgggctggtgttttatgttttttttcttatgcgatctttaactagctctctgagggggagctactactcccattttatagctaaagaaactgagactcagagagcttaagctacttgttccagatcatacaagagagagcctgagatttaaactcagacccgctacctccagcatccatccctcccctatcaaatctcgttgcctagacttctagtgattgacatatactcagcaaggctggaggtaagggaagcaacctattaaggacagttcttttgttttgtagaggctcattcttctgtttctaggataaggacagccctgtatagggtgttcagggttggctgaaggcctctgaagtcatgaggctgggccaacctgggtctggctgttggcacttattacccctctctgaattctccatagaatcaagttcttgaggggccatgactgccttcagataaggtgatacctggccctggggttaatttttatttattttaaagaacagttttagaataggtttagatttacacaacaatttcagaaagtacagagagcacccacatatttcctttaagtccccacctgtcactacagttttctctattattaacattttgcataattatggtatattagttgcaattggtgaaccactattgatacatttttattaattaaagccgcaatttaagaagggttcactgcttgtgttggacaagttctgtgggttttgacaaaagcatagtgtcatgtatccaccatgacaatgtcagacagaataatttcactgtccaaaatgtccgctgtcctccatctgtttatcccctcacacccttcaatccctggcgaccactgatctttctactgtctctatagtgttgtcttttccacatgtcatattgttggaatcatagtgtgtagccttttcagattggcttctttcacttagcaatatatgtttaaggtcctccatgtcttttcctggcttgatcgctcatttatttttttattttttattttatttacttatttatttattttgaaacggagtttcactctgtcgcccaggctggagtgcagtggcgcattcttggctcactgcaagctccacctcctgggttcacaccgttctcctgcctcagcctcctgagtagctgggactacaggcacccgccaccacgcctggctaattttttgtatttttagtagagaaggggtttcaccgtgttagcaaggatggtctcaatctctggacctagtgatctacccgtcccggccttccaaagtgctgggattacaggcgtgagccaccgtgcctggcctgatagctcagttattttattttatttctttttgagacaaagtctttcttgtccccatgctggagtgcgatggctcaatcccagctcactgcagcctccacctctcgggttcaagcgattctcatttatttttatcactgagcagtacttcattgtatggctgtattacagtttttatttcctcacttagtgaaaagcattgtgttagtttcttagggatgccggaatacagtaccataagttgggtggccccaaacaacagaaattttttatctcacagctctggaggcccaaagtctgaaatcaaggtgttgacagggccatcctccctctgaaacctataagggaatcaatccttcctttcctcttcctagtttctggtggtgttgctgggaatctttggcatcccttggcttgcagctgcatcactccaaccctctgtcttcataagactgcctttttgtaagaacaccagacatatagttttaggggcccatccttatcctcacttaagtaatcacatccacggtgactccatttctaaataaagtttacattgtaaggcactgggagttagggctttgacctagcttttttgagggggacataacctgtaacagacaacttcattgcttcctcttttgggcaattataaataaagctgcataaacattcatgtgcaggttttgtgtggaaataagtttttaactcatttgcataaatatctagacacgtgattgcctggtcatgtggtaagaatatgtttagcttcataagaaatagcaaaagtgaatggttataccaagtgaggttcattgcatttcacattagactggctttcaccaatcagctcctgcccgagggtctcctggcacttgtggatgcacactgtccttcttggtgtgcctggtgaagtgtatgtgttgtgtgtgtgtgtgtgtggccacacacgtgtgattgtaccaacctttctctcttctgctctaaagtataccggtaactgatgactgtgtaattcttattggatattcacattgactaatagtgagcatacttcacttctaagctgtcatcggtcaaagaccaattgccatgtttactaaaagactggcacctcttggtaccaaccaatgtgtccatgccttcacagcatttcaaaggcagcttgtcagggtgattctccatgatgtcagccctgaaccccacctttccaggcatcctaattcttttcactttcccagaagtcttgttgacactttctctttccctacatgtcactttcaagctggtttccatgctgaatccatttttccacatgagtttctagattttaaactatagatgtgcattcagctgctcctggctggtcaccccttcccatttctttcctagatctgtcctacatcctccctggctgacctggtagctctgtcttggcgtcgtcttggcccctcactctcatgacattgccaaaactccatctctgttggttctcttcaacttccttttctcttttactccttcagtcagtcaacaaacatccactgatcccttcttaagtaccaggcactctctgttaggccctggggatagagcagacaacctaccctttcttacccctctttagctacagagcagtagtgtggagttcctggcctcactctctttccctaggaaaactgcttgatgcattcccctctaacatatcagcccacaaggcaaagaacatctgcacagataaccaaagctggaactgctagatctgtgcactgtctctttagctgggacatcagagtgtgcaagcggcttatctcctccttttcttctgggtcaattaaccatgaagcttgctttttctggaagaggaattgcccaggccagtttccagctgtggtggggagcacagagcctgtgtgcataatgcagtattaacagtgcatcagcgtgatatagatttctgtcaccttctatgctaacaaacatcgcttagcgtagggtaatgatgggtgtttattcccagccacttaactcagcataatggacttgcagatgaaatacggaaaatgggctcctttgtctaggaggctggggcccttcctggaaccagtaacagaggcaacagcagcagctgctactcctgcagaaaaagtctttctagttctttctctagaagaagtccgggatggacttgcctgatgcaaagaaggagatctggttacagggctgggctgggagcatggggtgtgcggctgaagagggtaggttggcataccaggggctgctgttagcttcctgcggttgttttaggaggcaggctctgctagatgtgacatgggagagaaataggaccaaggtgggtgggggattctgatgggtcccctcttttattctcctggttggatcttgacagtccactctaggggaaccataagatgaatcttggtgactcttggttaataatggaaacatttagctttaacctttttcaccagttcagtatctccaggccctgcttggtaggcagtgtttcataaaacattttaaatggacataaattagtattgtctccctctgatttttcttcaatcttatcttcagattcagttagaataactaggagacccccaggaattctgtgatgctaggtttggtaagcccaaggtctctggagggagggatgagtctgaagacattactagtattctttctttgtagaaagagctggatgttgccagaatgagatatcttgggagccaagcaaataagtcctgggcccatgggcttgaactttagtatacatacaagcttgtccacagagtctcagcctcaagatattaatctctgctgggtgctgatgtctgagttccctaaatgttggtacaatccaagcatagcactttgacatttttcccccattcctggaagaaaaaaatcatatgaagccatttccctgaaattaattgaaaacactagactttcctagcatgcactttggagctaaaaccaactagttcaaagtgacagattagcattcatctccctgggccgagaccacctgccatccttgtggttatcatgacctcatctgctctgtgcctcactgccataatcacatactcaaagttagtagctgcatgcagtcatgctaattaagtaattaggtctaattatgctcactgtaaatacaaggtaattggctttaaaaaagtacttgagggataagcattcacttcatggtcgaggaggggaagaatgatgagacccccagccagcttggagtaatgtcatttcccggtgggatgggagcccaggggaagctgcacccaaaagctgaaggtgggcagaatatggagtgggtcctttctgttttgctcagtggcctagaaacagaaggactacttgtcttcctggcatgttttggcttcagtcttgtcttcaaggagtaagaggattaacttttctccagagatcctttctagctcaagatttcccagagataagtaatttatgttttttcttcgtcaactggattcaggcatccagtctgtattggagttttaaagggtcataattctgaaccaggtaaaacatatacataggggtcagataggaatcaaaagatgagcattattgttgcgcccaagaaggcagcttgggcgtaaagccaaaatgggttttttggtgcttctcctgtcttgaacttggatgtacagatagaacttgggtttgctgagcagatattattcattcagttgcatggaaggtcatggtttaccttaccttttggaagccagagagcttaagaacaccccaggaagctcatatgcacagggagagactccctttccttcatgaactttgcccagaagagaaatgtgatggtggatgatggactccgccctcatcacccatcaaataagtcacttgcttttcacagggagaagccaggaatgcagggtaagggaagggcttagggttacttcccatgtctccaaggagtcagacattcttattttaagggcagaagttaaaaatcagggaaagggaaaaagatctccttctcccacctacaagcaggaatctcggtagttgatggtggtctctattagtgttctctttccaaaagcccttttccaggagaaagcagtcatcatctccatcttgctgtgagtgaacacgtgagtcataccttatgacagatgtcccaaagaatttgtcggttctcattccccttgcactatattgttgatggtcaataactaaaaaccaaagctctacctacatcttagccaagaagccaagagtacaactgctcttccatcttctctccagctgcctttaattcattgttttgcaaattgttctctgaaggatacgaataggcattgcttaaaaaaaaaaagtttcatggtaaaataattttgggaaaacctggattaagtaactttcgtactgtaggattctgagagcctttaattctagagatccctgagacttaccaagaaggacctttggtctgcagcacttctcaaatttcttgagctactgaacctgattttgaggtatacctgttagcatctctgtagacacagatgtttcaatggatcccattcagggctgttctggggtttgggggctccattgttgcctccccagcaggtgtggtcactcactgtgacagtgcccagatgggcctgaacccatttggcacaggcactgtcacatttcctctcaagcccctcggagggacaggacgtagctgcattccgtgggaatagcccgaattggggtggtaacattcttcaggatttctggcagagcactaagtgccctccacttaaatggatcaggggatctttgcctgttgttctcttcctagaagctgttgcaggtgcttctaacacttcctaaaccccagatccggagatgctggtcatggccaaattttcactgcattcctcgtttccaggcagatctgctgcctcttaggaatggaatcttagggagctgctccaaggagaaatgcttaaatcaagatgcaggcagctttctcaaagtcactgtttccaaacaattgttgggaaggtcaaaacatcttatttaaagaagagaatataatggtcttggcatggagtaggcagggtctagcggctgagagaatgagctgaactagggggttacagaggatcctttttcattagaaacaaaagtgacatgagagtgggtggccttagacccaggtcccagcctaccactcagccactgcatgactgtgggcaagacacctgccttctctaaatttgagataagaaaaggtgaccaccttggcaggtatcttttgagatgaagcggtaggagaatttgaaaatactctgtaaacttgtataagtgacaatatgtgatcatccttgccttgacagcaatatttttacaactatcattacaatttctgatataaatatgctgttgggggaaaccagcttgatggtactgaaaaatatattttccaagcttggatttatttctgaaaaaagaatcccctccagcgacttctttcccccaactctaagaagcagcattttatcacccggctccacagctatgaagatgctcttaggagtcggaactgtaatatgttggttgtcaggaaatgatggatgtagatgagcagagggctcaggccaatttccttttgggttaatgagaccgaaactctgtgggctcaactagaaggtggcagagagattcatggcgagattcttttgtttgtgtttttgtttgattgattctttgtttcacccttccctttgtcatcaaacttaattttgttgaaacaaattccccttctcccctgtatgcctgcccatgtgctttacgctgagttctcatatgtttgtgcctgcacggtcccctccgaagttagggcttcaatgtctgtctgcttatttgacttcgtttttgcttgtccttagacatgagtgcacagcccttttgttttttcttagcaaacttacacataggatcttcagacacaaatgtacatatgtctgagtcttgttcatattctcatgttttagacactgattgtatcagttgagatccttttgactgaaagtacaagataatcctgactcacttggcttaagacgttgatcatcacataactcagctaaacagctagggaaggatcctgatgaagtgtattaggactctagctctactttttgtgattctcctgcctctgcctttctgtattttgctatatcaccaggttaacttctctcatggctacaaaatggttgcagcagatccaggcatcacaaccaaacacatggactaggggccccacagggttgtcttttcttgtgggtgggttgaaactgagaaagcttttcccaaagcccctaagtagtctttcctgtttcattggccagaattatgtcatatgtttattcccaagccagtcattcttaaggggaatggaattacccccaagcactttaagctcctccagattctcccctggggctgggaatggaactcattttccctgaggcatatggttgcctggagggcatatgtctccatagaatcacagggctctgttagcaagaaacaggaagtggctgttagaaatgacagtacctgccacccaggtctcctccaggagtaaagcaaatgctcacctaggctttcagccttgcaaatactgtcatcctgctcctctaggagtaagcaggtgcctcttggggtacagggggtagaatgaagatgagaacattgataccgtgtacattttactccttgtatctctcctcttagggagagcaacctagtaatttgttgttgtcatcatcactgttctggtctggtaaactgtcctgctaatgttcaaggctagacttgtatgcctgggtgatgaaacatttctgcttgtggttttagctggatccaactatcttggttgagcaagctgtgtgaattcctcagagctgctatgtgatcctttgggagcatagcttttggagagtaggtgggagcaggtaggtggtgaagagaggggaaaagggggagtagtaaaaaaataaagaaatgcattaacatttactgaatacttaccaagggccaggctctgaacttgaagtacattcaaataataataaaatcatacactgcgtagtgctttttatatcttaggcaccaaaatcagtttaaatataataataaattgtttaatcctcataaaaatcctatgaggtagcttctattactttccccattttgtaggtgaggaaactgaggcacagggaatggttaaaatgtttgctaaagtcttgcagctagaaaatgacaaaactgtgatatgacagagcccaccaccccctcttcttttcatgaagtcattctttctacattaaatcaagctttaatgtaagtgtagtgttccccactttacagattaggcatttcctagggaagcaaggaagttaagggacttgcccaaggtcatttactggtcaaaggtagagccaggattcaaactctagagtttaggagcatgccacttctactaacctgggataccccctcccaccgtcagctgacttccaattcacccacacccccaccttttgggagatcttggagactttcagacagataccagtttgggtgacccatggtgctcaccagtgaggcagcagaaggcaattcctctctagcactttagctcctatgtagtcatccccctccgtgtgtccaccccaggaggctctttggagcttcagatccccatgaggcaggcctcccagaagcagggtccagctagagatgggcattggtggtgatgcaagagctacccttgaaggagaagagcagaagtccttggatccaagttgacctatttttggccgagtctccttttatcctgtcgctggtggatctgtagcttgatttgtcacccagattgtggctgggcctctcagcaggcaatgtataagcttctgtccccagacctagaattgctggtgatatagcaactcttcgcattggattctgctgagtcgagcagccctcatgccactggtaatgaagaagtgttgggattaaactcctaatggctcattgattggttgaattatgctcagtgtaattctgaaaatagattttaaatatgtgcttggggatttgtggggatttgttacttaggagctttaactaaatcatggctggtttgacagagacatcaacacagggagcctgtgcctgggatgtgatgttcatctctgggtgacccctctccccctattccccaaagtcaggaaaatgtgctgggtggggtggctaggggtgggatggtcccccctcccttcacatatattcctttgttcaggtcttgagaaggtcagcttggttgaaccaaccactgcaaacccctcaatattgctaaggtgagatggagacatcacaggttctggattctcccttttatttcctctgaagttaagagcagaagttgtcttctttctaactccaagctttcacttttcctggagctgccactctggggaagaaccaaaggggaagccttcatggatgcttagctaatcagccttttggcatattctggtgccgtcttttccttctgcatccttgtatcctaggtctaaagggggagctgtatgaagggttcctggtcttgggctgagcttctaacatccatgcttcttttggtgaatgccaagttaacttggagacaatagaaaagctaatgaaggcccctctgtgagggagcaatcattagaaaataataatcagagacctcccagcacaccccaaatcactcaccttatatttctttccctctggtctatcagaaacctaaaatgcctcccatttttggtgcaaggtagatcagaaagaaacaagggatgttgtaagtgaggcttaatgaggcaaatttgaaagatgcagttagaccatatttccatggggaatttggtcaggggcttttttttttttttttttttttttaagcttcgtctcttccattttaacctctgtctgaaagggtatattccccttccctgggataatttatactcagccagtctttatgaaagaaaaaaaaatatccccagagaagggaggaagtaaaaacaaaacctggaagaaaagaaaaaaaaatgacactctcctctaataaagaaattactgacgttctacattatgaactgtattaatttttaatggctgagaaaggagttgatttataatgcatccttcccggctgcaaagcctgtccccagctaataaataaatgacaggtctcttgtattaaaagtatccatcatcttacagtgttggaatgtaaatggtgagaggcattgaatgagaggcccctgggagggggtgtgccctgctgtgcccagctggagaagagcctgccatagcattctgcttagttctgacacagcttagcccattccttcatcttgttttcagcaaagtgatccaaatagctgcaactcttacggtccaggagaaagttcataagaaaaggtgatgggccatttaggaacaattcatgatgtaaatttaaattcctggtgtttaagcaaaactgtccatggcttctccttacatatcctcagggcttcctcattggcttcccatgcatctctgggattatgtgttcagtagttcatcctttgatggtggtcacagctctggttagcctctctatgtctctttagaaaacagacagaacacctaacatttgtttctggtttcaaagtaatatacaatcactgaaaatattttgaggaaaatccagaaaagtgaaaagaagaaaataagaatcatccctaatgccaccccaagtgatgaatgcatgacattttgccttatatgcacaggctaataacatacgcagacatgtacacatcaacatggacatgtatagcacacacaaatgagatcatattctgcatacggtttcataatctgaatttgtcatctagtagcctatcatagacctttatttcacaatgccactatttttaatggctacataatacgtggccaggctatattcacattggagccgctgtagagctggcgatcagtcaatcaagatgcattccttcgttcttcattacagtgccaactccagaataaacatagtgcaggagaaaaactgagtacaaagatgatttttgcacagagctcctaatcttggagcaactactatgctgcagagtcaatgcagtgaggctgagagatgaacagagtggcatcatccccgcatgagggagtccacactccagctggggagacaggccaggaaacagttctggagatatgagcataatgagatgcctgccacagagaccctgcaactaaagggcccagtgtgcttagagagcagtggcttgtttaaattaggggagcagaggcttgggtaaaggctccacagaggggagagtgtttgagctaggacgctgcggggaaacttggactggcagagatggacaggaagggccttccaggccaccgtagcagtagcaggaggcagacagggggcagggtttggtgggggcagggctggaggtgagtgaccagagaaggactccctcccggggtggagggagcaggtcttgttgatgtattaaatagcatagcttattgacacaataattacgaatttattcgtagaatttgcacttacatagtccaggcctttgtttatcacgcttgtcactgtttctcagaagtaggtgatgactagaggagtgaagaaactatcaacactgtaataaaaaaggtaaaacaaagtagcaagttattctctctgaatttagggacagttccaggcagacatagagagacccctgttccagaaagaagagaaatgaaacactcactgaatatacctttcagcacagggaacgttatgtagaaaatgagagcgatctagcagttgctgccagcaggctccactccctctgatttatttatattgtcttcataggcttataaaaatggaagtttgcctagatttggagactaacatttctatcctttcacatatgaatttatttcttgatttgttgtgcatatttctaaacatagatcgaccaatgacttttgcttttggaaaaataaaaaagaaaatctcggagctggtgagaagaggaatcagagaccgtgttcctgcaaagaacctgctccggtgttgccggagaggtaggcggggaagcatccaagaagcatttattccttgagcacctgagagagcctgtttttttggcaggtggaaaagtggcagcccaagatcaagtcctagctggtcttggttttatcaccagttagttgcagttgcaatatgatcctcgcttatatttttgccttcaaatcttggacccaaaattattccagcaataggagttggctgaaagctaagtttttcctttcctgctctttaattctcattcacttaacttccttgtagaacatagaagtttttttaatctgaaaaatatctcagagatccagtgagacttatcttttcgtttagtagatgaggaaactgagggccaaacacatagttcaatgatattaaactgcataaggatttggaagaaggaacaggtctaggaccaatggctgttgtctcatgtttctcactcctgaaactgtaagtggaaatgcaatcttttcattttccccaaagttgatgttttttgtttgggccatttaataaggaatgtctgacaaaagtgaactgtctgactcaggtgcagtaattgccacagaaattggttttggtgtctttggggaattctgcagttgaacccagaaggcatccttatcaagtagcgtgttccaacacttttacaaattctaagaacctcagatatcactgttttcctttggagcgatattttgttattttagtaaactttcaaggggcactgccactttgctgcactggcttcctagtgagatacagtgttactatcttaagtctttttttaaaaaaattgagacagggtctcactgtatcgcctaagttggatggagtgcagtggtgtgatattggctcactgcagcctcaatctcctgggctcaatctgtcctcccacctcagcctcccaactagctgagactacaggcgcaccaccacgcctgctacctgggctcagtcaatccacctacctcagtcccccaaagtgctagatttataggcatgagccacagtgcctggccaagtcaggccctgctacaggattttttgtacatgatctgaaatgttgtctgcacttgaaggatctcttagaagggtgtctgagttcctactggcattgaaaaggaaggaaacttgaagctaggcatctgtttgattcccaggctgctttcatgttacttaatgctgtcagatcataaagggaattcatttctattcctcaacttctaaataacttcacacgatttacagttgacaaacagcacactgggactcttcttgcatttcattgtttctgtggaaaattggttgatagagcatcaccaagtgtatggcttcttatcctcaggcatttcttccaccaacactggcgatggtccactgtgcacagagctctgggttagagaaggaaccctgttccttttttccacagttctgttatctggttacgctctgacctagaggaagatgcgggtatgattttaaacagtctttaccagtgcacggtttcacctgctggtagtgggtctttaccagtgcacggtttcagctgctggtagtgggtctttaccagtgcacggtttcagctgctggtagtgggtctttaccagtgcacggtttcagctgctggtagtggggctttaccagtgcacggtttcagctgctggtagtgggtctttaccagtgcacggtttcagctgctggtagtgggtctttaccagtgcacggtttcagctgctggtagtggaatttcagaagaccgttgttcttcgaagtcaggggttatccaagtgtggtgtgcagaccagcagcatcagcattaactggaaacttgttagaaatgcaaattctcaggattcacttcagacccactgaatccgaaactctgggcatgggattcagcagtctgcatttcaataagccctctgggtgattccgatgcacatcaaagtatgagaagcacagtataagatattggtgtagtttcctttttcccccgatcaaaaatatctgaagaagctgagaagtgcttcaatatagttactaatagtgcattataaaacatttatttatttagtaaacatttattgagcatccattaagttctaggttctgtattgggtgttaggagcacaaataaaccagcaaatggctcattctgctgtggttgttttggtatgaacatatagaaatacttttttgtgacagtgatataaacaagaggttctcagcctcattctcaccctgcctgtgatttccgtgctatttctgggcctctccaaatgggcaagtttgccaaagctcggggtcagagtgtcctgagtgagaaggaggatgtaagcaaggcgcaagaatgagccatggctgggggaatgttgccagctctgcattttatttgtgaataataaggaaggaagtgagaaggtttgtgttttaggttgtgttaatacgtttcccttatgtcaaaaccaccaactcctagcaccctgtcaaaatggctgcactgaaatatcacagttcgtcgaggatctcattgtcttataggttcgtggaggatgtagagatggcaggatggcagccaaagagctgaaggtgggattctgtgaagaacaatgcatgctctctccttcatgctgcacaaggccgtagggtacagggtgggtgagctctgttggcttgaacattggagcctagacttgctgctgtgctctctccccatgtttctgtgtgtctgtcataaggtgggactaatgggaggatctgcctcactgggtcttcgtgtgtgttaaatgaggtaatgtacgtaagggatttggaatagctgcctgtgtttaggaagaaatggctcacttctggctgtcagcactattaccatagtctgccttagttatactacagaagaaattcacttctgcactactgggtcaccccagtggcaggcgaagggaggggcagtatctggctgtgcagactttccctgacattactgataaatcaactttcccatagagtaatgtgcggtgggaagtgtctccccatgtagaagctggtgtcctattgtgctgacgtaattcagtggcctgctcatgcatacactgccaggatgtgtatatcttcagctgcggcttcttttcagggatagacccaactcaccatgacccaaccccaaacttcacctcattgccaaagtcaaggagaagattttgccagaaaatatcagattactgagattttaattatgatttccaaatgttctgaaattataggaaggtagcaaatgccccatagtgtgttgagttgagacatctaacctcttcctgtttaatatggaaatgtgcatattttgtaagtccttacagacttactagtagagtcacattctcattcattcccagataaactttcttaaatcctgtctattttgatttcttaaagcaagctggagactgagctttctgttggtgatgaataggaattctagacagcaagaagcgagaggctgacctggtggagggaacaacagatacaaaggtgtggaggtgttttctggggacactcaggagctctggatgagtggggtggaaggtgtgtgggtgggatccagtcatgatggcctgtgtggcatgcttgttcattccaagccatttgaagataatactggataagaaaatatccctcaacaacccatggaccaggaaggaacgaaaagaaaaacatgtccaaaaggatggatttttttttatcccttcatgggtagtgtggtgtgacggcaaaaccctgaactgaaaatttgcattttgggaagtcattcatgtagggagtgaattagaatgcaagccagatccaggtaactgctgtgaatgcatgatgtggtggcaggtgaatgagttaggcacacggagatgtgtctgtgagtggtacaattagcccggctgtttcccaggttgcttctagtgtgataatactttgattttgtgtgtgtgtgtgtgtgtgggtgtgtgtgtaaattccagcagtgctagaggtaaaaatacatttagcaagttctgttattggctcttaagtggacaaaaatataatgcatattttaaaaataaaattctccttattcaataggtttattacattgcttttaggaataaaatctgttagtaatatataaatatcttcaccatgttattcatcatttgccaaaaaaaaagcatagtttcattcttcccatccttttccttttcttccggaaaaattactaaaaagcttggaaaaagaactaccagtttattttacataaattgttctcctttccccaggatactcatatcttaaatcattatagaggcggtggttggagccttgagaatgaattcacccagaatgagaaattgtagagaagacccgaagttccaagccaggaccctggactggagccgtgttttagagaaagaaaagaaaagcagatggcagggctattagaacgggcaaaggtggaaagagttttcacaagagaggtgatgttggaggctgaaggagtagacagagactggaccctcaagttgggttaggagctgaggcctggaagcctggactacaggggtgagggagatccctagattgctgggatctagagggggctggtcatgccaaaacaggccagagaacagaataaatggacaacatggccactgagcttttgctttgtagatttgaaagagatttgggggcaagctcgacatctaatcatttggaagaagatttattctactttactttctccatgatgttttttggcttggataagtttggtggatctgaggacaaaggaatccactatattgtttggaaggaaaagcagtctgtagtgtgcttttttctcactggatctgaggagattctgagaacaggagcagaggtgcctcctgtaacactgcagtggagagaagggtagaggctacctgtcctagtagaaaagtctggatttgagtttcaactccagctccagtgcttacaagctgcaaatcctttcacaggtcatttaacatcatatctgcaaagcagcatcttgtagggctcctggaagatagacaggttgcaaaacagcagcaggagggtcatgtgcaccctataggggtgtgtcctgtggcctatgcagagcgtatcattctttttgaattggttgctagcaagtaaaacttgacaaggttcacacaaaaaaatctctgcatttccagtttctcttgaaagatagaaggatctgtcaaaattggcttgcatttctgcatggcaaccattaggtggaacgtagaagcagtggacctttttccagagcttgtgttcccctttttgccagagtctccttttctccttattgtcttacacccaactctttctgctcatctacactgctcacctggcttttgtggccattttagtttgtgattctctctctccattttaaaaaaataaggaataaaggaaataaatgcaaagtgttctgcatatagtaatagcttcatacattcaatgttagctaatatcatcatcatcaaaattatcttcatagttttaagcaatatgaaattaatgtccctgatatgtcactgaggtaggggtttctccattgcctctttagctataagcctcaaaaacatgcagacaatgacaagtctcttcccactcaactggggatctcttccttctcaactagaggtcccctggaggcagaaagaaaacaaaatcaggaatctgttcttctttaacctgagagtagaaatccttcttcagtcctaatttttttcttctctaggcccgaggggggctggtctgtgaagtctgggacatctgagctactgctaatggaaagggaatcttccagcagggagagtgaagggaggtgctaaacatggaggtggatcttatatattccatttccgttagtggtcaagataatatttcagtaattgatatgcctttatgaataatggagtgtggatcaaaagaattgtagcgtctgtttaatatgaagaatcgctgggggccgagccctggttgctcctcatcagaactgcactgccaccaagagccttgagtgtcaggagactgggactcagaactgggaacttagtagaatttaaaatgtgaagcacttaaaggtcatatagttccatggatagtaaatatgtgtcctcaggaatctgcattggaatcaaccgggagcttttagaaaccactgtgtcctagggcctagggttcttggaccactgtgtccaagaacctcggagatcctggttcttggtctttgtgtggggtctgccagcttctctcggggctcacatgtacaagtgaatttggcacttgcatctactcttgttgctttacagatgaggaaactgaagccctgagtggttaagatacttgccccaagagacctagtgagttggtggcattggtagaaatagaaccaggtgtgccccactttcctttttcaccttaaatttaccagctaacattgaacacatggaacttctccaagagccaaccctgttatgctctaaggttctgggagtgtatttgctctctgtgagttttaggattctgctctttttcttcttctggagagatccaacccaaattaattttagttactttgcttcaggggacacttctcttctgaataggaacctctctctagtgtatgggaatagttttgttcccttagatctctgtatctctagagatatgtggccaagtcatcccagtagataattccttggcaaatcttctgtgcccatgattctaggaagctacagtcataaaggagcattttcttggtaacaaaggtctagaaatgcagcatcatagggtataaggcacgttaggggtcctattcatccacccattttacagacgagattactgaggcatagagagatcaagtggattgcccaagaaacacagctggtttgtgtgcagaagacaggaagaattagaactcaggtcttcagattcctctgcccagtgattgccttgatttcaatgagcacatctctggtggtagaatttcacatgcctggaaacaggcttaagacaaaagataaaacaggcttcccaggcacaaaccttctcttgtttctcaacaagtccaagttagaaaatcttaggattgaaaaagatacaacagatccttgtgggtgtgagtctcctgtccatcccttataggtggccatccaatttcagatcgtttttctagtgaccaaaagtcactctttccagagtgtccagtctcctttcaggcagctctaattgtgaaaaaggttgtcctatcctggcccaagaatcatctttttggggacccattccctggtcctgattgttctgcctgaaaccacttagccaacagtatggtattgtgagcaggatttgatgctgggcacaactgggttttggttccaccctgccgactactggttatgtgtcttggactagtcacttcagttctttaagccttgcttccttgtctgtaaataaggataacagaatgcccatataggatagttattatgaatataactcaagctatcattgtatcatacctagagcacatcccagcacatcaaccccttggttcaggcttgtccacattttggaggccgggggtcatgtctctcctcacgctaggttttttcatttttgtactaaaccttgccatggcctccatttgtcctcatgtggtgtcagttgacacaggtgggcacaagtgctccctgtgcctctcccagctgagcagactctcctgagatgggtctcagttgctttttcacgcatgaggaaggcaacgttaaaattactcgtggggttatcttagtggctctctgatggtgctgtgttctgaaatccacagtttggaaactagccgtcatgggctgtgcatgtgtgagtctgtatgtcatgtgtgcatttggaagcccagctgtgtgcctctgcgtacttctctccctgtgtgcatgtgttgtgctcctgtgtgctttcccacaaacctcagtgttcaagctacggatgtactagcccgttttcttttacatcaaggagatgctcactgcttcttcaaatcccagaatcatgccatcccatggggcagggctttttggttcatctcttatttccacctgaagccacatgtgtcctgtgcctgtggagggctgctgcccccagatagagctgcctctctgctgaggctgccaccagccaccagcaatcccttttcatgtgacctgcagttgtgcatgatgatctctatcaatcctttttccccaggctcctggtagtgcatagcattgcaccaggtgcttcaggagaaaagctgcctccactgctaatctgaaaagcactttgcctggaaagacacctgagacgtgtaagatattaatagctgcagaagtttcatccctgtgtaatttaaatccctttcccgaggaacactcttacggtgggggtggaagagaaggagagaaaagcctagaataattatgagaggttgtgggaaaaatttttttggggatgactgaaatattctagtttaatcatccaccctggtgcttgctggatttggtaatgaacatttttactttctccttaaagtcagaggctattttgacagctacagatgctgtaaattacaagtgttctgatatggtcctgtgagaagctcttgaaaaagtgttccactaaataagtttgggaagggctgtaaataccatctgcctcctagtgagccccagtgcacatcggcatttgaggggatgagagatccttcctacagaaacctcttatgctctggttatccttggatttaccatattgatgtgaagatagatttcctcaaatgtattgccctatctctgataggttgctaataatgttcaagggtaaaaactttgttgaaggggaatggaatgttatggaaattgaagtgtagactgtgtagttgttggggtagatgggggagggtctcaggcttattttggtaagagagggagactgcctcctagcacctttttctgtgctctggcccttaggcagtgggatatacagatgtcaggtattccaggatttgttgaaatctctcctttggagagatttgaggtggtctgttccatgcatggagtctaaagttgagacaagtcaaggcagttatcacacagagtgcagtgggagagccatgcagagggtaagatcaggtggctttgtaaaggaatccatgcagaacagtgtgttttagggcggacagactttaggctttaagggcaggccctttgctggacccattgacaaagtcactgacagctgtttggaacaattgcctaggaaagcctgtccccacaagactcttgtcttaacacaggcatcctaggtggtgatattgttactccatggacttctctggggccatcagaagtcctgaatgaactgggggtcaagctcatgaagcatctggctcctactcaggaaagcatggcagcctgtacttaggcttctctggcagcaccagggtgtgtccagaaagcatcaatcagggaagaacagtgtgagtgcctaatgaggatggatcccagtgagcaaagagacccaaatcaatagagggaaaacaaatgcaggtgaaaacctttggagtaacacgaatatagggttaaaacccagctctactttcatacctttgcacaaattacttaagctctctaggcctcatttttctcatctgtaagatgagaataataaataccactttgctaggcattgggaggatgaaatgatttcacacatggaatactccagcactgtgataaattccatccattcattctgctgccacagatcaagaggagttgaatgatagtgagaccatcattcacttgagccaatccttcccctagtgctacgattctgatcctgttcacttttaccccactttttcaagggtgagtctcacagagcttttaagtttggcctctcacactctcccacacctgctaaatccttataaatgtttcttctcttccctcaaacttccctcactgtcttatttgtttcttgccctgtggaaggcagtagggtacacattcttcttagtgtaaatatgccttgaatttgcacaagggcaggacaatgtgttcttttttccaacagctgttttgatgatgcttggcaacatgttggtatttttggcccgagtagcacatattgagaccacatcctcaaggaatactttttgatctctcccaagtctcttttctagactgaatggtttggattttccattgatgaaaaacattccccttttcttgcccacatgagagtttatctgcccgtttttctgatcatctctctcctcttgtttacagcacatgcaaaagtctcttgggctcttcctatagtttataacttttgttttagttttatattacctggaatagcttaggatcatctcagagggactctggcatagtccctcttggagatcagggatgccaggaggggcattaaggatggagagatcaggtgaatagtgaaggagtgatactggacaaattgtaaagctctaaagctccaccaggtggaggagggcacaggtgctgaaagacaagagaggtaagggaaagcctagaatcaagtcagaggcacagcaaacagaagtaccccaagcaagccagttagaccaagagagaggctcattgtcctgtcttttctttcttatgggtgcgtggccctgaagcaggagattctgctcttgaatgggaaagggttttcaagagactctttgaccagttctccatccatgagaatacatctcaattaccatggagacttccatcttaaaaatagccattgagtggaatcttagtgcaaaaaaaaaaaaaaaaaatccaaatatatcataacagttggttccttacacccttgtgcctatttactcttttgaagattttcatgaggtttgacttttccttatggagaaagtgtttgttcctccatatgttatattggcttagcaatgagtgattccctggttgaaactttgttccacagtcctctttcttctcagcggagcagtgcattgtagtagttagctgtgtgattgttggaggcatcctacctgggctcaaatctcagctctgcatcctggtaaccatgtaacattggcaagttacttaacctctctctatgccatagttctttcaccagtaaaattagaccaatatgttacctacttcatgggattctaaggtttaaaggaaataaaacctgccaaggactcaaaacagtgcctggtgcaaagttagctctcagatcatgccagtcaagaattttctctagggagctctgacgcacactggcatacagtttacctgtgagaccttggctctgctggaaaggaccttaacattttggtcagcaggtctacaggttcatagtattgttcaaagctcatagttggctgcttctacgcctcccagtttatctcctatataattgtcagttagatctagaccattctgtgtgtgtgccacacttgtgtgcttcaaaagacaagtgagtggctagcatttgattgccttgtaaagaattagtcaaataacttaatgattttttttctaaatctttcttgcttcttctcaaccttaagcatgccctttgctctgtgattattgggtggaaccaaagattcatgtgctggcacgctgcctttgatagatttaaagtcttctctctgatcttggcggatttttgaaaagtggtacttgaggtctgggactcattgaatatctgatttgagcttgctggcaaaggtccccactccccaggcttccttcctctttctctggcttggggagtctgctttttgttttttttccttcaataggccgtagttgtgataggctgagattcacctggttagtcatgcttgttttaattttctgttggtttaaaggatggatattttgattcataagaatcttgttttctccgggcttctagcaaggttttttttttttttttgcatagcttctcatgttttctgttgagtcttagtttttaaaaaactgtctctttttatttcaaggtgagagttacagtgaaattgtatacctttgtttgttgctttgtttgccattccaggatcaaaaatctatcctaagaattaaagcagagatctcagattctctgaatgtcagcttctagtttggtgttagttagatatattaattggggaagggcttccctaccctctgtagttcctagcaatcttagtcatcagggatgagggctggggcacataaacactatcacagattcaccatttccttgagggcagggtcactttgctggtggaaattttttgaacaaggccttccattatccatccttggctgaacttatgtctttcttttgagattttatgatggtacagttctcctgtgtgagcctgaatgctttatagcttgaggagttgagaaaactcgaaatagtccaactcttagattttcagtttggaaaaaaaaaaaaaaaaaaaaaaaacaaccactatccttcagagagagaaaatccctttacaatacacctggccaacattatcatccttctctgggaataattccaatgatgaagagttcacaatctcccatggactttattatatcaatgcatagatatctatactcatttttactctatttttaaatcaaatatcattttcattcaacaactggcatgtatgtatgtatattgattggaagaattaatattattaatataccagtactccttaaattgacctgcagatttaaccacagtctgtcaaaattcaggcctcttttttgcagaaattgacatgctgatcctaaaacctataggaaaatccagaagattcaaaatagcctaacaaacctgaaaaagaagaacaaatttggaggttctaactcctcaatcccaaaacttattacaaagctacagtaatagagacgatatggtactgccatgaggatagacatagatcaatggagtagaattgagagtccagaaatagacttgtacttttgcggtcaactgatttttcaacaatgttgccaaaacaattcaaaaaggatataatagtcttttaaacaaatagtcctgggacaatgagctattcacgtgctcattgtgaacttggaacccctaccacataccatatacaaaaattaactcaaaatggatctaagacctaaatgtaagcattgaaacaataaaactcttagaagaaaacttaggtgcaagtttctgtagacttggattaggtaatgatttcttatatatgacaccaaaaacacaagtaacaaaagaaaaaatatatatatcagacttcatcaaaattgaaaacttttttgcttcagtggacaccaacaagaaaatgaagaggcaacccactgaatggtagaaaatatttgtaaatcatatctgataagggagtagtatccagaatatataaagaacacttacaactcaataaaaagacaacccaataaaaaatgggcaaatggtttgaatagacatttctcaaagaagatatacaaatagccaataagcacaggaaaagttgctcattataattagtcattagggaaatgcaaatccacattgtaatatcattttatacccactggaatggttacaataaaaaatgttggacagtaaaaagtattggtgaggatgtgaagaaagtagaacctttacaccttaatgttggtaatataaaatgatgcagctgctttgggaaatagtttgacatatattcaaaaagttaaacattgaattaccatatgacctaccaattccacttctaggtgcataatagagaattgaaaacgtgttcatgcaaaaacttgtacatgaatattcacagcaagattattcataatagctaaaaagcagaaacagtgtaaatgttcaccaacttaaaaatggactaagaatataatatatccatggaatattattgaaccataaaaaggaatagagtattggtacttgctacaacatggttaaagcttgcaaacagtatgtcaagtgaaagaagctagattcaaagtaactacatatttaatgattcaatttctatgatttgtccagaataagcaaatccataataccagcaagtagattagtggttgtttccaggggtcagaggcacacagggtgatgaataactgctaatggatatggtttattcatgtgtatgtgtgtatgtgtgtgtggtatagttttaaagggtgaattttatgttttgtgaattatatttccataaatgattctaagagaaaaaaaccctgcctggtatacactgccctattggaagagattcttgcacctgaccttgcatgagctccttgttcgattgtgagaattctcagaggagggggctggggccagcatgacagtgttgagggtctgagtactcaaggcaggggctatttactaactagtatggacatatgtcgacattttaacaaagagtgtgaatatacagctacctgtccactattagtccctacctgtgtctaaatcctcagacttccactcctggattaccccactgggggcaacagaaagtgtatatacacccctacacatttcttgaatatcaccatcatagcactaagaagtctgatacttgaatatcaccatcatagcattaagaagtctgataagtatcactatcatagcactaagaagtccaagccctgtactctcagatccctaagtctgtgggtcaggagctgattaaatcagcatttcaattaatattttggagtaggtccttatagaggatggtggaaatttgtctggttctatggaatcatattgcaatgtaatagaaatacctcctccctccctctttgataagaatcatttgtattctttagtaagcctctattgtctgtcccagtgccatcttcctcatctgaattcagaattccatgagcctatcctaagtctgaaagatgtagtcttaaagataaacttttccaatttagtcatgtcctcagctccttatcatgcccctatccacagcagctttttgtgatagggcctgccatattcctcccagggaaatatctacatggctcgatgcatgggaaataaaatttgcatgaaggaagaaaagacatctacatgttatttattcagtgacatcccatttcattgcaaaaaatgtttgaggtgctttgcaaaaatgcaaatgtaatgcaacaaagatgaataatgggagtgacagtatctggtaatagtgggggatacatgtaagaaaataaaattagtggcaagtttagactactaagtacctgctgctagagggaccttagagatctggctctgggcatcctagtggccaaggaacaaaggtaagcatcaaaggttacaggctgtcattcagaggaagaatatcttttccattgttcagaggaatagtgtggggatgcagtattatactttccagcttcctgacagtagatctaacagtgcacctcttaggggtgtttgttaaaatatcctgtgatgcaagtcagtggcttcatgtccaaacccacttcataaagtaggtgggttggcatgggggagagaagctttgagaagcacccacaggagcctttcataccctgggcagactaaggcactgcttggaaatggggatcctttgggaagccccatttttgaggattgattgaattgccttcctccattgcagtacatcacctctggggccttactggttggcttttgcagccagcaatcctcctccccccacactccctaccagcaaggcatttctttccagggttattggaacttcatcatgtgaggcagtaagtcattgcagtccagaacaaatctcacttgacatttttatcttgactcttctgggggcctttaattagcatgattgcagtgcaggcaattgtttcaatggagtctgtgttgctcttggttggcataatggctattgaagtttctctatttgctgtttctggccatccaggaaagattctgattaaataagtaattaaactccctaatgtggtataataaggggtggttggctgtgagtttacatggattaaaaatgcatcagaatatggattcatatagttataaaagcatcactgcttaaagtccaatgtgacttgtttgcacgagagctcccaggacttccagagctctacaacagccactgtatagacatctgaagctggcatcgccactgccccataacacatacagccaccatgtccttggccatgtggccatgatgcacacaactacagcaggcagctatgacattctcagctcttgttaatggtctatgggcttttaggagcagcatcagtatatgttatggttaaacatggaactcagctagcattagtggtcctgattctcccagttcctgaatcataagctgcagtgaaaatttcctacttgtagcagtggttctcaaccagggtgattctgtccctaggggatttttgacaatgtctagagacactttcgatgatcacaatggggtggaggatgctattcacatccagtgaggagagaccagggatactgctaaatatcccacaatgctcaggacagccccccaaaaccaagaattatctggtccaaaatgtcattgcactaacattcaaagataattcctacattaccttctttagagctcatgatgtttttgtgacggagaaggtacaaaagttttatctcccttttacagattggaaaactgaaacttggaaagacagtgactctcccctgtcccacagggctagaccatcatctggttctcattctacagctatttgcacacgttgtgtgggatggtgtgagctttggggtctctacaagtgtccaaaaggggcacaagtgttatctaagtgcctatggcacatctctggagaaactatgaccccaggtttcttacgtaagaaacgtacctcaatttcatattttttccctaggaatcaaagaacacatatccatcaaaagtattgtataatgataacacttgatcacatttgacacttgatacttgagatttttagaataagagtatatgatctgccaaagagaactcatataaaaaaaatatttactgctcaaaatctgtgtgtctgtttgtgatatatttgcaggtaagatttccctccaggccctgccaatttagtggaataacaagcgggagaagggtcatgcagggtggtaagaatgcagttgtattcacatcctcgttgcctgagaattttgaaggatatatagaaggaggagactctaccacagagaatgcatagcaaatgtctcattgatgcttcatcgccttctctctcttcttaggacactcacggctgtcttgttgaatattgtttacagctcgcatttggaattggaatgtaattcatgccaattgttgccagacaattgtatgaagcactgtatgcttcacccaaatatctataatcccttgggtctccaagggaagtatagttatccccattatgcaggtgggaagactgagctcaggaggttactggtgcctgatccacatctgcctaatggcagaactggaagtgaaacttagaatttgcttacattccccttgactacactgccatgttagtcacagcaattacatcttactctttgctcctcatttaggaagaggaaacagggctgctaggcattgaatgtgttgttgtatctcctgcctcttaaggcagtgagtgcatttgggggataataggcacagtgaggtcccaaaagaattcatctacacactaaaagtttataaaataaattgacctaacattaacctcagttcttccactgatcttagcaagtctaaagtggctctaaactgagtagagtataccgcagttcttggaactcagagctcctctgtgtgctgccatgcctggctggaagagccttatttaatagcaagtggcttgcctcaggtctgatgaaataaagtcaagggcatgaggtttctaattcatagttcaagcattgccacacttctttaagcattgcaggcatgctgtcctgagtttgtgctgaacacatcaccaacttcttttccgttgctctcctgtgttgctaatggtcttgtcataatcacactggagaaccctggagcagcccagacactgcctcctctcccaccccctatgtttaatctgatgccaagtttctgatttgcataagctctacctttgcatccctctggcatccatcctcttggttctccttcagcgatcccagccctaatgtatcacgtgtccaggatggtactgtcaccgtttaacccagggggccacaaactatagcctgcaagcccaatccagcctgtttctgtacaactcttaagctaagaatggttttattttattttattttattttatttttagagacggagtctctctctgtcgcccaggctggagtgcagtggtgcgatctcacctcactgcaacctccgcctcccgggttcaagtgattcttctgcctcagcctcccaagtagctgggattacaggtgcgtgccaccatgcccggctaatttttgtatttttagtagagatggggtttcgtcatgctggccaggctggtcttgaactcctgacctcaggtgatccacctgcctcagccttccaaagtgctgggattacaagcatgaaccatcacacccagccggtttttatgtttttaaatggttggaaaaattcaaagaagaatcatcttttgtaacacgtgaaaattatatgaaattcaaatttcaatgtctctaaataaatttattgggactcagccatgttcattcattgcacattgtctatggctgccttcgtgctgcaacggcagagttgagtagctgcaacagagaccgtatggcctgaaaagcctataatatttactgtctgtctcttgacagagaaagcttgctggcccctgccctagctagaccagccactgctgacctttctctgtctcatctttcattccttttaatcttttctctggtcatcccctctttgaaatccttcaagactcacccattgcccaaaactctcaagttccttcatgatctgcccccaagctaatcatttccatttattaataggaactccttgcacttccccaagtgtgtcttgtacttccccactatggctgtcagtgtggtgctttattccaggaataacttctcttcctatcttcttaggagaaaatcttatgtctcctttaggcctcatggcaacagctgtctcctccaagaaagctaagtctcctactattgctacctcttaggaatgccctagcactctccctgtactgcttttattccttgaggttctttctgtcacagtctgactgtttcagcctaggttgtgcagtttctactaggggtgagatctgtgagggctaaggcacagatttggtgagtgcaggctgggtgtgtctacctgagcaggtgctctctgggctccatgggacactctgctttcccaggtgtgtaattcctatgaatttccaggacttttgttctcctaaacctatgtgacattgttttgaaagtgggaaacagaattcaacatttggaaattgatttttaacattaatgtgaaaagccattatcattagttgaaggtacatcacttaatctaaatctcttatctaagtatctatccatgtctatatctattgacccaacatctgtcatcttcatttatccatctatccatctgtcagtcttcatctctatctattgatccataccagtgcccacatctaaattccacagctgcagttctagcactgtcacttgattggtgatgtcccatttttatggagttactcacagatagtcctgcaacatcgtgttcctaatctcccttactgagctgcttcccatttttcccatattcctgccttatgttcctgccaaattatgtactttccttctcagggaagaaacaattcctgttttagtttgctagggctgctgtaacaaagtgccacaaactggatggcctagaacaacagaaatttattttctcggttctggaggcccgaaatccaagatcaaggtgtctggagggctgtgagccccctgaaggcactagggaaggatctgttccaggcccctcttctagctttggtagtttgctggcaattttggacatttgttggcttgtagacacattatgcagatctctgccttcatgttcacatggtgttctgtgcgtgtgtatctatctgtgttcacatttttcctttgtataaggacgtagtaatattggattagggcccatcctagtgacttcatcttaacttgaacatctgcaaagatcccgttttcaaataaggtgacaatatgaggtactgtggtgatggtgtttgaggggcacaattcaatccctaacagttccctatttgctatgctttgtctgttgctcccgccacatggaatgtctcccgctccccagcccatgcatttctgcctggtgaccatttttctcactgcctctttcccacccgcatgtgatcttatgaccactccctcactacaatccctcagctgtgggtgtatgcctctctcttgccactcaccagtgaaataccataatataatctgttttaggaccccatgactaaacttcccatgctctcttttcctttttactttctcagctcctggaagattgatatttaggtatttgcaaaattatttttaggtaagcttacagaggtatagactcccattcttggcactgggtttttagctcctctttgcagtcattgttttttactcttcttactcatcttgatattgcctctccctttatccagctctgaacatagtggccatgagcataggaggccctcaatgtgtgttggttatttggagatttggaggacagtgcaagcagggatttgatatacatttgctggtatctgctatagtgcctggcactgcaaaatgctgatgcttgggagctgtgtagtatatatcttccactctttttctaggcctttgggggaggtgatgacacctgcactgcctaaactgagtattttgtgtgtgtgtctctgtgtatgagtatgcttccatcaaattaaaaaggacccaaagaaaggtgaagaactattcttctctactgatgtacaatgggacacctttcctccgtcttcttttccccttcatcaccttcagtaacttcttcatcatcacaaatcttggaattcagagccaaaaaatcccaactcagaggtttatattatttgattttttagggccataaatttagaatgagccagctatctgatcctattagccacatcttgatcttagataatctgcttaaaattgataccaccctggaatgtggactttactgattgcatttcctgccagattctgacttttgtcttttgctcatcatatcctaaatggtacggccatgactccaagggaagttgagcaccctggggtagcagttgggacttgaagatgttggttccaggagccatatggccaagtcagggtaggaggcattgatgttaagatattttttttctttccttacctcagagttattttgaaagtaacataatcatttttaaagtccttagaaggagaaatgctttgcaagtgccaagatactgtagtgcagcctgaagataatgtggcatattgttgtacagatcacacacacacaagtcagattacatggttctgaaaaaacaagacttcaattgtctgaaatccgtatctatcacatgggaaatagagagagctgttggatttgtttcctgcccttggcatctacatatagagggggttaagaacatgggagctgagatggcaaaacctggattcaagtcctggctctgcctcccattaacagggcaacttggcatgaattactgagcatctctgccccttcatttctgcatccacaaaccagggtccataccagttctcccctcatagggatgctgagaaggtcagattagaaaatccatgcacagcactttgctcattgcctgggcaagtgaaagtgcttatagatattggttgttggtttttttttccaaatagtcttattaagaaatgaaaaataaatccatgaaccatttcattgtagtgtatgcgtctgaaacagttccaggtaagaggagaagaattatcaaacagaaatgaacaattaactgccaagtggcttatacagagagtggagtctgagctgggggtgaaaggattgaacggcaattggatgagaaaaataaattagaagataagcattcaggacagtggaatactgtggaagtgaggacagaagctgaaaggcatacagtgtggtcagagtttatgtgaacaagagagtgtgagtagggaaggagtagatgatgagaccaaatggttggctggagatagagtatgtcaatatcaggatggcagcctaagctgtttgggcatcacacagtggcactttcaagtcactggtggcttctgagtgattggtgaatggaatttttattgatatgattggacaataatacataaaatggattaacttaaggactggaagctgggaaacatgttaagaagcccccaaacagtggccctaaaatagggttgagtgatgaggaagcataagccaagatttgttcatcatctagtgtgtgccatgtgccagatactgacctgggtgcctttaaaattaaaaaaaaaaatcacaacagcatctgggagatagacaaagatatcctcagatatcctcagaaggggaaactgaggcttagggaagttaagtaatttacttaaagttactatctctcaacttttctgccatgctttgctaaagtggggatctaaattaaagaatgtgttcatgagatattccaaaacaaatcattgaaatcaggtgtttgatatggggaattagaaaggcactggcaagaaatgaagatgactccaagagtttgaacttaggtaattataagcatgatatgactttagagaattggcctgtcagaaagggaaattgtttgggatggggattgtagaaatgttgagtttgttgttatgatgcacaataatgggaatgccaagaagccagctgccattgtgagaataaaattcagaagaaagtttgtgctggagataaagggctagaagtcaccgcacaggagatggacattaatgatggagggtacagggagatggagagaggagcagacggctagagcagcatttcccacattttactctgcatagaaatcatctgaggattctgttaaaatgcagatcccaatccggtaggttttggatggagcctgagatgctgcatttctgacaaactcctggtgatcctgttgctgtcagtctgagatccaaaccttatgtagccaggggtgaaaagactgatgcttgagaaactagcatagggaccagtgaaggaagagaagccaacagaaagaaagggagcagaaaggtaggaaaatgatgaggatggtacagtactctaggtgtcatggggggtgtgggatggtcaaggtgccacattctgtggaatgaacaaggtaaaatgatcaaagagtggagaaaatctagtcatggggtaaccattggtgaccttcaagaggtcagttttgtaaaaggattagaacttggattatgggaatgtaatcatgaatgatctgcaaaacagtggaggttagggttggaattaagttatgcaaattgttggtatccaaaggaactaagaaaatgggatgaaaacaaatggtatggtaaagtgggggacattgctccatcatttactaggtaagagactgagagtgtgggcatacatttgtttggtatgtgtgcacatacccaaagatagagataaacatatatagatttctgtacaaaagggaatataacagcaaaggcagaagatgttgaagagacaggaaataattgaagaaggaagttggagataatattgaaggtatcagttaaagggttagttttggaaacaaaataaatttttctccaatatagaaaggcaaataattgggctctggtcaggatggtaccataagtttgtgctttagtttcctcctctgctccaaatatgtaacaatgacaaaaattataaaaagacatggctgggccccaaaacaagataaataatctgtgaacaagaaatggtacagaaataaaaagtgatgtgcagagttacattcattgttacgctgggttccaagtctagaatcaaaaagtcagggcaggaatttagctctggagggtatctgcagaacggtatgtgctccacattgtcagaggatcagagctagactcactgcttcaagtcttggggtggggatagtgaagaaaagagtctgaaaagataatgtggctgacccctatctgggttcctaataggaacctgtgagcctgaggaagtgggagagagacgataaagttgtagctttgagaccatgaactgacttaagccgctcaactagctgaagactgttgtactctaccctcagtattacccttgtaggaggactccaagtcattattataggatttggtttataattgaagtcccaggaagctagatggaggtaacaacaacagcagcaacaaattagacaatatgagtgagaagaaaaggaaaagggaaaaaacaaagaaaaccagaaaaaattcttttcactcaaaatgaattaaagtgaaaaatcttgaaacaagcccaggcatgatggctcacacctgtaatcccagcgctttgggaggctgaggtgggcgcatcccttgaggtcaggagttatagaccagtctggccaacatggtgaaaccacatctctactaaaaatacaaaaattagccaagtgtggtagtgtgcacctgtaatcccagctacttaagtggctgaggcatgagaatctctttttttttttcgtgtcagcactagatctatatgatttattttcttggactttttttttatactttaagttctagggtacatgtgcacaacgtgcaggtttgttacatatgtatacatgtgccatgttggtgtgctgcacccattaactcgtcatttacattaggtatatctcctaatgctattcctccccctcccccaactccacaacaggccccagtgtgtgatgttcccttcctgtgtccaagtgttctcattgttcgattcccacctatgagtgagaacatgtggtgtttggttttttgtccttgcgatagtttgctgagaatgatggtttccagcttcatccatgtccctgcaaaggaaatgaacacatcattttttatggctgcttagtattccatggtgtatatgtgctgcattttcttaatccagtctatcattgatggacatttgggttggttccaagtcttcactattgtgaatagtaacacaataaacatacgtgtgcatgtgtctttatagcagcatgatttataatcctttgggtatatacccagtaatgggatggctggatcaaatggtatctctagttctagatccttgaggaattgccacactgtcttccacaatggttgaactagtttatagtcccaccaacagtgtaaaagtattcctatttctccactgttggacccaggaggtgaaagttgcagtgagccaagattgcaccactgcactccagcctgggtgacagagccagaccctctctaaaaaaaataaaaataaaaaaaagtatgaaacacatgaaaaaaatataatgataagcatgtttgttattatgtatgacttttattcagtaatattcttgtaatgctagccacttcaataagataaaagaaataaaagaattggaaagacagattatccttattgtgaagattctgatcaccctacatagaacatcaaagggtatttataaaataatcattagaactaattagggagtccagcaaatttgctaatataggatcaataaacaaaaatcaacgtcttccctaaacaccattaaattataaattctgaatgaaaatttaaagtataactttctattttaaatcagctttttattttaaaatagctttagacatatagaagttataacagtggtaccgagcattcccttatatctctcatccagtttctcctattgtaatcattctatatcaccatgatacatttgtcacaagtaagaaatgagtgtaggtacattattcttaattaagttcaatactatactctgatttcatcagtttcccccaaatgtcctttctccattcctggaccacatccagaacaccactttacatttagttatcatgtcttcttagccttctatgatctctgacagtttcttagactttccttgtccttgattaccttgatggtcaggtttcatgtagaatatctctcaattttggctgtcagttgggatattgggaaggaagaccacagaggtgaaaggccattctcatcacttcacttaaagagtgcatgcttatcacatgacttaacactgatgatgctaaccctcattacctggctgagatggtgtttgtcagttttctccactgcaaaactacattctccctctttccgtatactttggaagtaagccaataacagtgtacactcaaggggtggggggaagtgaaactctacgtccttgagtgaggagtctctgcgtaaagtattcgtaattcttctgtaagggagatttattaaacgtagtacttttatcttatatttattattattattattattattttgagacagattctcactgtgtcacccaggctggagtgcagtgtcacgatctcggccacgtccggccctaaacgtagtacttttaaaggaaaaggtaatatcctgacattgaggaggaaaatatctcttaacatacagatttaagtaacataaagggaaaggtgaatacatttgaatacattaatttaaaaaaaaatctatgagtactgtatacaaagttaaaagacaaacagtatcttgagatgacatcatttcaatgcatatatatataacaaagaatttgcatagagaataaataacaaactcccacaaatcaagaaaagagtaactacacacacacacacacacacacatctatctatctatatatatctatgtctagatatatagatagagagagaaagacacacacaagaaaatgaggaaaggatacaaataggcagttcacagttccttaattggggaaacccttattgagatgatgtacaacctcagtagtaattagggaaatgaatcttaaaactacaaggagataacatcttccacccatcagtttgttagaaaaaatatctgatatgggaagatggggtaggaagttcatccatttagtgattatagaaatatgagttggtaatactttgggtaaacatttagcaatagaattatgttaaggattcaattacactaaatttagggatctcttccaaagatgtgcttctcaaatgtttttgtgcgtagaaatcacctgaggagcttattaaaccacagatgttgattcagcggggtctgagcatcttcatttttacccaactaccagctgatgctgatgctgcttgtccacttgcctgcactttgagtaaaaaagctctagagtagaggtcagcaaactatcactcattggccaagggccaaatctggctcttgcctatttttacaaatgaaattttactggaacactctcatttgtttatgtgttgtctgtggctgccttcagactatactggcagagtttagtggtagcagcagagactgcatggtttgcaaagcctaaaatattttctatctggtcctttataggataagtttgccaactactgctctggagaaattctcccacatgtgcatacagatatgtgtgtaataatattgatcgcaactttttttggaataatcaaaagatagaaacaagtgtcagttggcagaataggcagataatttgtagcatattcacatcatggacttcgttagctaaaattaatgaacgggagctacatgtatcaacatggataaatctagaaaatacccactttttaaaagcttaaacttacacagaacaaaactataatttggttatggatatatgcatatgcagcaaaattatttcaagattcctgaaaaggataatcagctatttcagagcagtggttacttctggtgatggggtagaggagaaacagggttatatgtgaactcacatgggttctcagccattgcagtaatggattatttgtttagaaatttgagaagaagatatcaaaatattataaattgttaatgctggaggtaggcacagagtttctacacttttctgatattttagatatttcaaacatttgaaaagagtcaaaagactcaggaaaaaatatactgaatacaaagacagatattttgaagtacaaggaaggcaatgaagatagattattaatacccgagattctctctactctcagttaagcaagaaaagaagatgctcagctattacaaattgttccttatttagtgaattctgagaatggtaaagaaattttttttccatatgactagtattgctccatggcttatgaagtattatgattctaagaggtcacttcacccatgttatggagtggaaggattttcactttctctggggactaacatttcactcctttaagccaagatcagcttatcattggaatagtcttagtgattccaagtggtgggtggccccccagcacacctcccccctttttttgagttagagccttgaaatactcatcagggacaagctgtgagagccttcaagatcccttcaggagcgagtcttttgcttttgtctgagaatctcagtggtccatgcccctttatctcagccaggcatggatgtcctccccctgtgacttcctgtgggcatgacgccatgagctaaattgtagtcggggtacattcagcctcagccccctccctctgagcatctgcacacagctggaaccagacttggcaaccgtggcatgcgggccaggacaatctcgtcactcattttcccagcagcattgaggtgactttataggaagaggcggcccatactgaagttgggggtctcagttcagtactcttagctacacagtatacaacagggacattttggttctaagtacctttcaatattgtatagaaccctttgaaatgtgtttgttattatagggatgtaggaacactttgggtccagttattcccccatgaaatgtacagctatattaaaaagtcctgcttgttggcattcaacaaccttttgtcgtgtgccttatacatgtcaggcaatgcggaagacacagccagtggatgacatgagtgccaccttctctcccagcagtagctttttccagcattatgcttcagcatggtgtcctgttgggaacctgatttctgaccatgcttgcttcccttactcacatagttcagtttctgagctgtctcccccttctgagataggtttgtccctctgctgtaggtttccagccacttctttatcattgttagccatgaccagagggagcataagtttggtattttaggggcattcaacaaggcttgcagagatgggatttcctggtcttaatgcacagcctataacctagtacaataaacataatgtttattgtacagtttgaatctcaaatgcaaagacaagccatgtaggtactgtaaataagtgcaggggtgaaggataataggaattggtggagaatatggcaagctggagaacacacactcacacacctcgtataaactgagtggctaccgcagtgggttatcactgtgcagtaattctggcccagggttgccagaactctcggactttcaagggaagctagaaatggggatattttaaatgtgagatctcccaagttttaaatgctggcaactaagcaacaaatttttaaaaagaccatttgtgttaaaaaataaaataaaaggcacatcataaggccatatacggcctgtgggttaggtttgcaatctcagagtaataaaagaaataacctgaaagtttaaagcagcatagactgtggccagcaagcctaggcgtttggggctcactcacctcggccagtgccgccatccttttattgaatccgatggcatgagaagaaagaacttagactcaaaaaagcgataactacacccaaggaaaagatacagaacaaatcaatcataaccatagcccaggcaccattagaatgctttgatgatcaccttcccacaaccttagaagggccaccatacaggcaagaaaagaagcaagagacatgtgtctatgaggaatcctttcttcaccaagattcactcgtttctgtccatgcttgtttacacagtggcctggggtgggtgctcaggaaagagttccactgggtaccatgcttggcttaccaagggtattctcagatattccacaacccttggttagggtatgactatattttaattatccatctctccatactcattactacctcacgttcatgtggtcatttttcatcctctctaggctgaactccctgaaacatcatcaaaatgaaggggtccgtgaccagacagagtttgggtttccttatctggaaggtcccagtgcatgcgaagtgtcattgtgagggtgggggtgaagccaccagggatagaattaaaccagggttggccaggggagggaatgacagggtatggtgctgcttaccttcctaactaaggaagctgttaataaggtaagaaagccctgccctctgtttagaacttgttgaagtggccagagtgagagccctgttcccccaagagaacgtccttaccatcactatcttgacctccatttcacccccttcctggatattggttttccacaaatgagatccgtattgcaaagtggttagttgcaaggactttggaggtatgaagagctggattcaaatttagactttgccacaaagtgaacttggggctgtttttccatattataaaggcacagttttctcccttgtaaagtggagttaatactatccaccttttggggatgttgaggtataaagaactaactgtaggtgatacctgtcactggcactcccttatatagatctatggattccagggctatcagcaacatgtctgatggtacgattggcatagttgggtattgctcggggctccctgctccattccatgcctacctgcaatggggttgaaaaacatctcacctcttcttacctcttgggggaaaggtgggaaagttgtggaaagtgtggcaccctgactggggtgggatgcccttcccactgcattgccttctggctccctgttagtctaccacccagggccccagcgccagcactcctgtgtatttcagcccatgctagggtacaaaatgcttttttccacagccagtgctatgtcagtgctaagggttactgtgatgtagcaacttgaagatgatgaatgaatacatttgaagaggggatgtttgaaaataattctatagaactgcatttggtattgggactgttgtctaaaccataacctaaactactttatgcagttaggtaatagtctcatctcagataacaaaaggaagaagcagagacagaaggagaaggagaggtctgtgagaatccacagtcaggtggaaagagtgtaggcagaagatgcagggaataccttctccctggaaggtgctgggctggtagctccagaatcccaaggccagagcacaggggtgaaaccccagcaagggagagagaattagaatctgcaagaatctcagaaaaacagatttgaatgtctttttatgtggcaaaaccatgggaactgacctttccttgctgcagtcaatataaaggacttgcctttagagattcaaccagctcttgactcaataggattggctccaaaacctctcatccaatcgtatgggtgctcaatgccccttctcccctaagctccatttacagtgtccctccctttcccaaaaagatcccagagcctctggcttgcttctcagggaaagtattcttagaagatccctgaagacccagctctgttctgaattacagagagcctacaggtacctttgtgctgaatgttttggggaaagctgttgacagacagaggaaaaggtcagatgtagcggggtctgtgggcccctggtgggtaaggccttctttggaaatgcctttgatttgcccctcttcagccttttcttcaccatttacccctttaccagtgtccactgtggttctgggctcccctgctcttcccccagtaaatgccttttgctttctgctcaggggttgttctgagacagagggagaggaatggaggattttggagcagtgcctcttatgctatcaggcttcagcttttagaatcttggaaagactccacctgggaaagagttccagagaaaacaaacttcagatcccggctcatatgggaaagggctcatgttcacgaaggcagcttcggggacattggcagagacttaggcgggcttggccctggtctttaatggatccgacacggatctttccagggcccacaaatgctgcatggtctccaaaggagatttcatcctcagaagctacaatgatatctctttatagaagttgtagtcttcaggtcttcagtgagctaacagcttttgtttttccaatggtttatgccctaacaatggcaaggaagattttaaggaaccaaacaccaccacctcctctcatctcctcatcatccccgccttgtcacattgctttcctcttgaaaattagctgaatttttttgatgggatattagaagccagaaagagggtcttgggtccaggattatctcccaagtcagaagaaacatccatccaggcccaggaatgacactctgaatggcaatgatgggcaccattttgagacattctggtccaagaaggaaaatggggggcaaatatgttaggaaaagtgcaggacagagttcatggtgatggtgaatctttcttctctgactctaacttgtgccatttctataatgccagggtgagattcttaggatctagattttatgcgtaaaataaaccagctgccactacaggcacagcagagtgggtacaggagctgagaaacctggatttctgtttctggcattgtgcacttaagaaaaatactttcccatgttttttgcacttggggtttaatactgaccattaattcccccatgtctgcctcttctgccaggggtcttttcaaacatagacaatcatgggatattaaacttgaaggacaatagagatcatctagtcccatcaactcactatatatatgaggaacctgaggtccagagtggggaagtgtcttacccaaggtcacatggtgagttacctcctttgacgtctttgtatgcagtaaagatccctcccctaaccaattttggttcttaagaccttaagactcatcaagcctccatatatttcgtggactgaggtacgactaggtgcccagcacgggatttggtactaaaaaaatcccttaaattaaaggagtgtcttccaggggaggaagcttcatagggcctaggtaagggctatgggagaagcaggagaggaccatggcctggaaagagacagtggtgtcacaaactttctcagcaggctacccagaccaatggccttccttcccttttccttcataccccagataacctttatctggggtcagggcagggatgctgtctcagaaatgtctcaccttgaaacagcctccctccaaacatgatgtcataggcaaggaaggtttcctctatcttcacaaatctgaccccacctccttcagaggaaggggtcccagcaccccaaatgactcaatactgttttgtccatagcatgtcctgggcaggaggacaggaaagtctcaatgcaatcaaattttgtttcaagtttttcccatcatattcccaatgtccagaggccccttatgacctctacattcctgagcatagcttccataaaaagataggcttactctgtgcacatattcacacacacatacacattcaaacacacacatatgtgtacacacacatatattcgcacatacatgcaaacacacatggaaacacatacacacatccacatgaaaacacacaggtgtacacatgcaaacacaaacatacagatgcacacaaacacacaaatacacatgcaaacacacatgcaaacagatacacacatggaaacacatgtacacatgcaaacacacacacatgcaaatgcacacacacactctttacacacacttttaaaatctgtagttgattgaacaacatctttctggaaattttattaggaactcccacttttcaggatatcctaactcagtccatggctgtatggccagaaaggaaatgagctgtcatggaagtcctccttgctcgaggcagcacgtggcctcggggccaccagtgttactcctccagggtattttcctcccctgtaagatttggaaagatggcaaggctcagagatcagccgttactctctaaaccttccacagacctgtggtgtgaggcgaaaaggtcaatgagaaagagcttgtaggcttgggagtatagcacccccacctcctggtgtggtcagaagtggtctgtgtaattttagctcctagaattagaaatgcccctctggtatccttaaagagtgtcagttctgggaaagcatagccttctcctcccatcccttagcccctaagtgaccctacagtgcataccccttctccgacacacccctcagctcatcgtcagggtctcctcctttcagaaagatgcttatagactgagacccacttagatgagacctctcctcctcttccatgacaatccaaggccaagcccccaaaggttttgctcccttcccttcctcagttcagtggaggctgcagcaaaatggagtgtttccagtttctctgaccatgcagggttttaagttaatcccctcctcctatccttcccttttgctgacagttcttcccctttcaagctccctctctatttcccctcctagttttgatcttctttgggggttttggtttttactttattttgcttttttctgtttttttttctttttgttttttataggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccctgcttggaagcgtggggtctccctggctctcccaggataccatgctgtcctcttagtgacctcgtcgccctgcaacctccagtggggaagagtcacagagagcacctaagcagaggtggagacggcgcggtaagaggagggggagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatgaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgtcaggatcccagcccgattctgcaaatgcctccatggggtttaaaaacatgaggctttccaagttcttgcccagtatctggggcagcctccagagtatcacctgggagttcaggttctctccagggctccaggtgtgtgtttatctcgccccctccagctctcctcatcctgctccccattgctccatgtcaggctgttccccattgtgccctgctgatgctttgggtccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatgaaatgactgaatcagacctcttatttggaaattttgcaaaaacattcaaaatacagaaattccaggttacctgcattttttcctgttttcctgttactcttttaaagaagtttcttagttaagttctttgtttacaaaggtgttcacaatctgttccattggttgctttcattgagagtcttccagatagcttaggctcatacagtaaagtgctttttcatcgtattgagaaagaattagaggctcagagaggttgaatggttcatccagggtcacacagtgtgagaggtgaaagcaagattcaaatctgacttctacagacactactcaggccactgagaccctcactcctttggtagctggggaatgttctgttgtctgagcagccaaggctcacagaaatcttctcttgagagctgatatatgggggtctgagagtggggttggggatcctttatctttggtgcaccagcaaagccagtggggctgtccctaggatggagtggttttgtatgttccctgtggatgttgggaaagtgaccttgcccaaggaaagacggggctttgggcgtacaggtcaacacacttgtcattcagagacacactccctttcatgcacacactcaggtgagccacactctcatggcaagtttcatgtgggctgccaggagggagaggccaaagagtaaaatgcttagatgaactggcacatctgtgcacccttggaccctggcagtgacacagctagaagagttgaaatgctccctgtaacttgccctcttcctttcaggaggagaggacaccgtgaggccctgtatgcaggagagatggagcaagagtggagaatgcgggccgggaaaaggctcctgggtggatctgaatgcttcactgggccccagtaatccctgatggagctcagtcattgaggcagtagagatgagacaagtaaagtaatgtggaagagctcacgttccagtctgacaggaagttgatcaggctaggttggtgcttttctatataccctcagttgctttatcttctatttaagtctagtttggtttgagacccccttatgccaaatggaagctcctgctctctagagtggcctgggtgaggggtagaccaagctcggcatttatctcttcttgagggttccaaggagaaagagttggaacagggatgcctgaagggttgaggctgtcctggggaccatgaggacatgcactggttcgagggagaactttcatttttaatataggagagatttgagctttctttttttctgatgcttggagcctatcagtgtatgggagaagagataatagataaagatggcccctgagaatatgggaaggaaaagtatccacagctcaggaggaagggatagcattggcctcatggagggagtgctcttcccatagagcaggaggcaaaaagaggaaaggatgtggaatgtcttttcaaggtgatagggcaaggaagtgagggagttcttgtctggtggcttccatttttcctataaagaatgaggcaaggccttgtgctgctagtgagaagacccaaggagagttggaacatctgaattgacggggaagagactatggacgactatggggatctatggaaaggttgctgggcagaatgaggaaccagctgcgattggagtctaggcctccgttttccatgttttactgctaggtgttgaagtctcatggcatttaccccagggttggtgcctctagggaagtcagagctggtatagggcagatgcggagagctgaactcagcccagaaagatgccagtttggactggcctcagcttagggtggctcagggaaccagccagtcctgcagctccctgacctcctgcattcgaatgtcaccaacaggatttcacagtagctttgtcagaccttaagcttacattttgatcctgcgggattttgctgcacagattgacagctgactcagttcacgaacccagggtgcttgccaggcgctccctggatcttcattctagagacttggttgacaggtgctggttctgaagctcagagaatgagaaactcaactgtaccaataagatcttgtagaaacaaggtgaaattcgatctaacacattccagggacatgccctggagaggctggacttttttactagcattacatgatgaggtcctggaactggttgccaacctcccaagaatgggtttactgtggggcattaatagtaataattctatgtaacttatgaagcacttactcagaaccagtcagattttacccacaaggaagctgaagctcagaaagattgaataactagctcaggtttccacagcttgaaactggcagaaccaggactgacagggggactgcctgacacctcaaaatgcttttggccactctgcagccccctaaagtagcacatcttctgctcctggaaggctatgattgtgaaacaccacctaggtgctcccccctccaaccccactccactcctaagacagagaagtctttcaggggtcttcagggatgagcaccatccctgacttccttctggaacttttgggacagggtgattttaaagactggaaaagaacatctgcaacgttctttcctctcattgtagcatttagtgacttgggggtgtatgaaagcatggttgggcttagatctgagattaatcacatgtcttacagttggtgagattcccaagcaatgatggcctttttgatattggggaggactcatcatacagttggatgagaccaacctgatccttaggatagcagttaggctgcccaggtctgggcaagggtgagaagcttcagataggaaggtggtagaagaaaggatgagaccaacctgatccttaggatatcaggttaggctgcccaggtctgggcaagggtgagcagcttcagacaggaaggtagtagaagaaagggccttgtctgactacccactgtcacttaacctttcttcaacgcacctcaaagacctcctgatatgtccaagctcagccatgcaatgctcaccctaaaaagaccaaacacaaatcaggctcaatttggaagtcaagaatctgacctctagccacctctgtctcttcttttgtgcgggaatccctttctgcagccaagctcccagcagccacatcctcacctccacctccccagccacaggtgtgaccgcagcacagcactgggctgtgacacatcccctggctcgtcccagttccctcaggtcaagaccaggcatgagcaaaggatcaagcatctcagatacaatggtgaggcagcaagggagggttggatgccgcgggaaagctcaggagcgggcagatcaatgcaggacgacttcattgttgtgtagctttctgcacggagccagacatggattaggcaaagagccggagcctttgttccttcagggtttactgactcctgtgctctggctagactcgcacattgctgccagcatgactctgaaagcaagagcaaaatgaaggtggcagggagggagagacagggagggggagaggggcgatgctggctgcttggagtcttctctgtgaagggcccagggaaaactcttaagcatgacagcagagacgggaggaaggtggagaacaatggggagtctggcttccatctagactgtccagcacgggcctggagctctcctcctcctctctcccagctctcccccacccaccacattgccaatctttaatgctggctgatgtgggcgaaactgcttgcagcctccagattccttggatagctctggttctgcattttgcctttagaaatcctactgttaccaccccctatacttcccacctcccaagaaaacctcagcctagatctgacagtatatttccagagctaaataagactccttcttcaaccctacttgaacccaaaagtgagttgaaggagatatgctggcaagagataagtcccttgtctgcttttttgggtggttctgaaattccatcaggattctgaggccctcttgggtaggacttttgttccagtttctcctactcagtggataaaacttgcatagagtgaccccagtttcccttgaaattaaatcttgataagggaagagatttctgcacgggtgataaggtctaacacccctctgtgtttttgccccttttcattttggcacattttccttctatcacaaaatatctgggtgtttgtgcctgagagagctagatcttctctcctcattatgcttgacttctgggtgggtgtgaatgcattgctcaaaggttctgtatgctcctgggccaggatggcgaggaatgacaaaaacgagggggacaaggaagatatcagaggcaaacctttgactggggcatgctctgctttgagagaagggaacaagaaagacaggagcacttctgaggagcacagatcccacagggacgtagaaggtactgatggctcagatttggtatcaaaggcctccagcccaggtctgtgtgggttgtatctgggaaggaacttggaactctgaggtagaggaaaacggcagggttgcaaattacccagagaactgagctgtagagaaatcttagctgagggctctggtgggactttcaaaccaagatacatgagccttccatatgggaccagatgggcacctggctttctcaggatcatggtattttctcatgaccctctaccaaaaggatcctctcaaagcttctcttaaatagatgatttaaggctttgatttacctatgggtggggactggggcctttggcgtaagtcaagaagaatggagcttggcttttctgagagccaaaaccctcgagcagttctcacttcacaccctaagagtaatgtcaagtaatgtctgagtttggaggggtggtcaaaatcccctgctcagctatggagagggtttgcagagcaaggagtgaggctgcccaaaggcatcgttccagtatggcagtccctgacttttgtcttcttccaagtttgagggacagaacatcatgtcacctcagaaaacactaccaaacctggctttggtaagtaatgctggaagcctttgtggattgcagtgatgaccagcttgtcttcatggctgtctttgcctcagtttctgccacctgtgtgctgttatcatggcagctcaatgaagcctagctctgcctttggagacctcactggagcaagtggcctatttccctgaaaaagacacattctcccctcccttgccctcaagttcattctgcagtgagaaggacaaggacttagccttggcaaaggggaaagtgacttcactgctgtctaatatggcctggtgatacctctgttacagagttctgatagaccacttactttctcactccaaagctcacactaccttcagtctgtttgggacctcgtaatgtcgtttaaaaatcacattgtggtattctttgctctgcaaggcttgcaatagcctttggtcaaaagtcatgaaatcctgaccttcaaaaacgcacttctcttaaaaagagagggtgtggagctgtggggagcacatgtgctcttctagggatggggcaggtctacagagcctgtgacatggtccttggcagctgcacaggcctagggaaatatttacctctcacagctaggttcttgagcgtgtcgggagctcatgacatggagggtcctctagttttaagctgaaagggtttagcctctgtgacgcaggggacccctgcacctacaaaggctaatttccagtctttctcagcactgggtcagacaagcagtctccaagctctgccctcttgctgccaaagtcaaggcaagggtgacagaaggaacattccagagtactggctagatactaactaaatctagcctattaattatattctgtcagaatctctggatgctcttgctattaattctgaaagaaaattcacatggcagagaacatgagagtaaatctcaaacaacttctgtcaagactgctagttcctgacagctcaccctggccaggagggcacagccaggatctgtgatgctctctggttgcccccaaccggcgaccatagctcctcactgaggccttttgcttcagagggagccagatatagagctggccagggagaacttgagtctgtttcctcccactgtcagtgggcagcaggggaggcaccaccaatatagaacatattctgagaatgtccttcttgggagaatttaaattctaagttcatgtttaaatgactcacagaatcgttcaatctttatggctgtcaatttggcatttcttgctaccataacaggagattgctacacagtacctctgataccaaatggccaacctagtcgttaagaagaccagaataaccccactgtgcattttcaggatggtgtctttggccatcttaataattttattgggtcaatcacttgaccaactgttatcctgcataaattggtctgttttctgggcagagcttcagggcctgcaatatggttctcccttaatttgaaatccccaacttgcagaaaaatctttttctcttcctccagttactagacaaatgatgttgtaaggatcaagtgctcccctttttattgattgcagcaatgtttctccttagtctcatgatatgccaaggatccatcagagaactttggagaatgttgcacaatatggccagctcttagagtttcacagtttgcattaggatatcaaaggctccaagaagtcctgctgtaaacaaaccttattctacctctttccaattctaattaaacacaaaacattcttcatttaatatctattaatagactcagcacacacatgttagaaaacactgggttatagtgtgatcagaagcttttaaagaagaatcaagcaggatgtgttcgtcaaccacccacttcttatatcaagaaaccaccacacccagcacgctacccagctctaggctcagccctcacttctgccttctacgtagagtcagaaaaaattctggttgctgatggatagacactcttgtgaagatcaggaaaccttcgctgtgatatctcagaagaaaatggtaagtcatttcacataagagcttgagacctcagcattaaacctggccatccgcccaggctggtggaggtgacatcatctagtggtagcatacagcaatgaagacccggatcccagtctcaactctaccactagcaaaatgacatggggtaagttacctttccttgttccatatttgtctctgagtagctagtagagtttgctgatcctcatgtaaaagaccctgcctggacagatgccccaaataccatgtccccatgagtcactgttgtctcttagtggaggacatctcttggttcctggtccttctctctctctgaatatgttgtgtataaggcaaactgagtgagagagatggctgcccctttgggtgaggatcagtggatttctctggatgagggtggaagcagatgcttgggggttaatagaccctctctgtcacagctggacaaggccaagcgggagttctcggcaagattttctgaaattgatctcaagaaggcagctctgcctaacaaatagtctgaaatgtcaaagtataaatgttaaagcttgaggggtcattctccagggagttgcctgggctggctagggagggagaggaggagggagagagggacacagcagaatccttcacataaagattctgacttggttttgtgatatttaagaaaaaagaaaactctgaattatttatagcacagaagatgtaagcaggctgtagagaagtagcctggcttcacatgatagtttatggccattatttagctgccccagccttgaactggtaaaacttttctcattagtcacatgctgttgagctctacttgagctatctatctatctattcttcttattattgctattatcattattttaatcaagaaaattcatgtccttcaatatatgagttgggggacgcaatttctggaaatgatatttgcacaaagcaggagttacctctttcccttaaagggactctggcacacgcgtcagtaactctttccacccctgtgggtgtttccagcctgtgcctcttcaagcagggattcggaaggcccctgctctgatatgagtgggaagcatctccgtttgggcctgggcaccaattggccatgtcaatctgggaaggtgaatttcatctctcattcgttccctctgaaagatgaaggcaattgtcctatgcctcttctgagtatgctgggcataggaaggataattccattgtgttcaaaataccttggtacctggcagggggtggggggatagcatctatgttatgtgaggagataaaagaagtaaagaaatgttaaaaggttaaataaaaactgattgaaggattggtggtaaagctggggggaatgagttctttcatctgtttattttggtcagtgataaaatgaatgcttcatgttgataatcatatcctgattctatagcatgggtaattgaaattcaccaataatccccaaattgcagttagaatcacaagcttcacatgctctctcttccatctctacacatggtacaaacacgctcttagtcactctcctaattgtttttgcatacccttgacaatactctgggagatgcaaacacatggagtcaacttttggtcagtttaggggtggtgaggtgaggttagtcaaactgcaaattagatcatcagtagagctccaaacaagcaatattgtatttaggaggtgttgcttttgttgaagatatcaatactttcgtttctttcctagacctgtttttttttctaccttgaagaacctggagaacattttgcagttaaaatgtcacagtgacactcctgttataaaactctgaacgtgtacatatttttaccctcactaacttactctacctcccagaagtctttgaagtgttttgcctccactccctacttgctgtgatgtagaagttaggctagcaccattgctctagggcagtggttctcaaagtttttggtcttgggacttcttttcacttaaaagtcatagaaaccccaaatgatgtttgtttctgtgggttatatccatcatattcactgcatttgaaattaaaactgagtataatttaaaagctcaagtatacacacacattccatgtagctgtcaggatgatgacatcatcacatgtctggaaaccactggacaacttcatgaataatacctgcgagacacgagagtaaaaaaggcatacactatcttactattgctgggaaaatagttttgacacatgaatctcctgaaagggtcttgagcccaccagggacctttggaccattttgagacctgctgttctaggaaaacaggcacaagcagattctgaaatcaaacctgagtccctttggagccagggaaatctaccagtcatgcactttgatccaagtgtagaagtccatcagaattccatttctttactcagacatcactgactgccccatgggtgttgacttaaagcaaactggctacaaccatgcatgttcagttgctaggaatgtggaaaatatacaagaaagacttcacctattataagaaaacagagtgggggctgtttgcttgctctggagaagaacatgggcttgatgtcacagtaaacattattggttgattgaagagactcagcacgaacaggatttacaaaatcccattggtgagagcaggaggcatgaatggcatgggatgagagaatttataagcagcaccttgctggttgggcatcccttcattgcactgtagctctcattgtgcatcacatttggacttgtttaaggaacatgtgaggctcgcagtgctctagccaggacctatgggagtgcctatttaagtttagacactctggcacctccttcctctttctcctaagctgggcagcttcggtataggaagattggactatgaaatgctttaatgtctagggagcttccttaggttaactctgtatagcacccagcacaccacccagcagagggacctgtctcatcatgaggtcctaagtgggtgacagtgttcatgcctcttcctgttcatcatttataccccggggagcaagaactgcccttctgtgggattatttcacaaacccaccggaatagggtctttcaaggaatacctctgagatcatgagcaaatgttgcttaattgactcattcttcaaacatatttggggcatccactctgtgccacacactctgctactaagtgagtcagttgtatttcctgtcatcaagagctttattgtctcctgcactggttttcaattgggggtgatcttgtcccctaagggacatgtgtggagacatttttggttgtgacaactgagggtgggtgcttctgacagctccccacaagaaagaatgatccagccccaaatgctaacagtattaacgttgagaaaccccagtctagagacaatacagtccagtattcactagtcttgggtaagaggggacctccccactttttagggccctcctttagctgccaaaagtcctagggccatgagaagggaccatctggagcctgcaccccacctcccttctagacaatgtttcatttcctaaaccagaattccttacccaaacagctctcagcttgcctccaggacacatgcgggtctcttcattcatctgttctaagggtgggctacgctgcaggtacgtgtactgctaagcccaagagttggccaaaggattactgtgtgggggcagtgggaacatcgagagtgtcagggtgggacggttagaggaagatggagttgcaggctcagtgtgcacacatatgtacgcgagacccctttcactgtgggatggaagatgggggtggaagagaagggaacaggccaggggccaactccttagcaccatgtgtctccactcgcaaatctgaggaaccagagacaccggaagtcacctggtccttcaggtcatcctgaagatcaatttcgcagggcaggaggataagacatgccttatttattagtgtgttagcttgatttataacttccaaattttagacatgtgtgtgtgcttctaattattcccttgtcccaagtccttcaaatgtaaggaataggcctggtatagataagtgagtaattatgaagcaatatgatgaaattatgggagaggtaaacatagaggaaagacacctagttcccaagtggagttttttgtttgtttgtttgtttgtttgtttgtttgtttgagacagttttgctctatcatccaggctggaatgcagtggtgtgatctcggctcactgcaacttccacctcctgggcttaagtgattctcaagcctcagcctcccgagtagctgggattacaggtgcccgccaccacacctggcagatttttgtatttttagtagagatggggtttcaccacgttggccaggctggtctcaaactcctgatctcaagtgatccacctgcctcggcctcccaaagtgctgggattacacacatgagccaccttgctcagcctaatggagttcttaaaaatactgaatcatgatattgatctgcagatgtttaaataaaaatggcagttcaaagaatggcataatcaaaatgatcagttaagactttaaagtttccattgtttagagagagctgccttcaagccttggaaatcctgactccactgcctggtgaataaacaccacggtcctttggtgacctcgggctgcctgaggtacacaattgtggaggttcttcctgctggacagtctccacactggggcaatgctcttacaggcccacccagttgccatagagactgatctcgaggtctccacaattgactggtatttactggggatctgcagctttctggatgccgtgaccagcatcataaaggaaagagaggggctgccccttcccggctccccatctgtggactattgtgagaatatctctctgtcacagaaaggtaaagaccctggagaaattgaataggaaggatagtttttttcttttaataacattgtgcttttttctgattacaaaggtaatttatattcacagtagaaaattcagtgaaatacagaaaagcacacaaacacataaattatccaccatcccatcacccagagacaacactgttaacatttcagctttctgccttctaatcttttttatgtacttatttgtcagaatcaaatcattccacgtgcacatgcacatacacattactttgctacctttttttaaaaataagattgcatttgcaatttaactgatcttttgcaatgttaaaaatttttgtggaagtgatatattcaccacatggttaaaaaaatacacacatatacacacacacaaacttgcacagaaatgttcatagcagcatttttcataatggtcaagagcagaaaaacgcaatgtttattgactggtgaatggagaaagaaaatgtggtgtaaccatagaatggattactactcagcaataaaaaggaatgaagcacttacacatgctacaacatgaatgaatctcagagaaacatgctaagtagctggacacaaaacatcccattttctatgatgccatttgtgtgcaatgtcaagaagaggcaaatacggagagacagaaattatattagtggctgcctaaggctggggttggaagcagggattaactataaatggacccagggttcttgttggggtgatgaatgtttgaaaactggtttatgctggtgattataccattcagtagatttactaaaagttgttgaattttacattaaaataggtgaattttatggtatgtaaaataatgtctcaataaagtttgtatatatatacaaaataagttatataataaatatgtaaaataaagtttgcatgtatgaactcaatgatgcttgtatataatacatagtaaatatataatatataaactaaacatatataatatatgtaaactttattgaagtattatcattatttatccaaattactgctacagattgatctatctgtctataaaatgagagcactccccttttttacacctgttcctcattggcaagttgttcctagcaccgctaccattaccagataagtaacctctgttattgagtgtccttatgaattatatctaagccaattatatacaaacagatataaatgtatgttgtttattttttctctattttgtacaactgcagctgtgtcatacatactattgtgcactttttaggataatcccttccccaccccagtttcttggagctcttagagaactccctcattgttgttttagagatccatactatcctgttatattgatgtactcaaatttatttaatttcttcacaacagtttgctcttataaaacacggaaatggattgatcctaaatatattgaaactaaataaatgtggttgaacctaaatataatattaacataaagccgtatgacccctataagctatttggtatatctgttttgtatatattggccatatggggtgataccaatgtgtaccccaagagtaatacagatgctcctcaatttaccatgaggctatgtcctgataaacccatgataagttgaaaatatcacaggttgaaaatgcacttaataacacctaacttaccaaccatcatcgcttagactagcctaccttaaatgtgctcagaacactgacattagcctacagttgggcaaaatcatgtaacacaaagcttactttataataaagtactgaatatctcatgtaatttatggaataccatactgaaagtgaaaagcagaataatttcacaccatagtgaaattgaaaagtcccaagtcgaaccatcgttcagtgggggactgtccatatatgagaatgagattccccacagtcttaataaacagagggtcatggcttgacttttaatgactgtgtcatgctccactgtgtggacataccagatttatttgtctagtcccctgtgtttgaaaacttggattgttttatttttccattcttacgaaaaacagcacaagtatttaggtactcttggtggttaagctgaacaagggagatggctcagtggcagccctcatcagagatagtatgtctgtcactgcattgctacctctgatgaggactgcaggtatccagtggattcccccaagcaggtatccagtggattctcctgagggacagctatcttgtaacagagagctgactgtggaaagctatctccttctgaaacattattgcttcagacccaaagatgcaacacgttgaatgcagaggtcattatcttttttcaggtaacatcaagatgttgccaacattcacataatgttgttccccaaagggctcttctggccagagccttgccacattttagggctggggattctgagctgcacagtccagaaatgttaatggaattctgaatgaagcctctaatctctatgtcctgcagagggttaaccaagcgtgatgccatgactttctcaaggtcagagtgagggttgggaggtagtacccatgtatcctgacctcttgctctgacctttaagcaggcggcgtccttggaacacatcgggtggggcatggcagtagagattgaagctggctgtaaaaggccacagacaattcagagagaggcatttccagccaacccactgatctgggctccaggcaagggaggggcacaaactggagagaagtcaaccagctggaaggaattcaaggaaatagcaacaggaaatctgaaggggtggagagattgctagtgagattatctaaatctgcagcttttgaggccaagtgatagccatgttttctctctagcagccctcagcggtgacagcaaagcccatgctgtggcttcaacacctctcctcctctttttctaacaaacagggtctttagtgtctttctaggggtgagcatggatggggccaaagatggtcaggcaggagaaatatatcctcttcctctcctcttctgggttcctgagctcttgtctgctgaagataagtcctgggggaaggaaaggtctttagacagcagagcagatgatgcagaaagagcccaaacatatgcacgggcaagacaagcataaagtgatgatattagggatcaagatccaatggcaacagggaagggagaaaaaagctgggtgtgggaggagcattgtagttgaaaccaataagtgcaattaggtttgtgtcacttcctacagcccaagcaagctgtttgttggtcatctgttagaggtggctgccaagatgccatgtgcattccaagatccctgggtgctggcccttcctatctgccaggccgagagagggacaatggatgccagctctggaagtccactcagccatgtgtggcccacctctctggtatgctcctggaagcaggggtagttggaatcaaggaaatacagcatcagaaagaagtctgagcacctgctcattgctttccttgcaatggggttgagaagaagcagttataggtggattgaatcaggggttaatggctaggccaaagggaagcctggtgctctcaccaacacaccaatgtccatctgttgcttagcccatctgggcatgccctgggcaggacctgctgcagctcagaaagcaggagcttttaggggacagactgcaccctcaggaattggccttgccactgcagcccacttcagacctgacttacttcctgcctgattaactttcccatctcccaccccagctcctgctgtagctggtatgccaatcggcaaacctgctaatactacagtgcccagaaaagtgggtgctcaaaaaatatttgttcatttaagaaagttattagctaaggcatcaattaaatgcgactttaaaaaatctccctagaaggagtgtctccagattctttggaaatctacccacatagctagcttgagttttttagggatcggtggcatatgttcttcttttaatgacagtcaacagtttaatgatagtctctaaacttaatgccaagtgtaggctatgcatcaggtttacatggtggattcaaacctggtctgtgattcagagggagatggctgtgcacagggaagtcatataccacattgtgataagtacccatatgccctgggcttcctggaatttcagaatcctgatcatacctatgtctgtcgagataagtgagtaccccatctcatcagatgcaaggctgctaatgatcagagaggccaggtaggcattagtcagactgtgaaggatttaaacttcacctgtgttgaatgaggactaggaaaaagcagttgggcctgggcatcagagatcactgtgactttataacaggtaaagtcaggggggtgaagtggtagaagtgagagtgaaatgaggcttgagaaatgattgggaagcagaagaatgatatggcacgccgcttagactacccatcagagtctggtgatgaaggcagacaaaggagtaatttctaggggaggacgggtcaaggaaatactttgattaggatgggggaggccaggcatagtgtctcacacctgaaatcccagcacttttggaggccaaggcaggcagattctttgaggccgggagttcaagaccagcctggccaacatggcaaaacaccatctccactaaaaatataaaaattagccaggtgtagtggcacacacccatgatctcagctactagggaggctgaggcaggagaatcccttgaacctgggaggcagaggttgctgtgagccgagatggcaccactgcactccagcctgggtgagagagcgaaactctgcctcaaaaaaaaaaaggatggggggaagctttattctgtaggtgagaagtcagtgggcaagaggggtttatagtagtgaagagagacgggtgctagatgggtccacatccaaaaagtagatggaaaaaaaaggagataaaagcttgagtggaagctttacaaccttagaagaaagagaagagttattaattcatgtaagatgaaaaataaacatgaggtaagtagaattgaagacagagggaaataagggaatttcttcctatttccctagctcatctgagagttagtccatttatactgggagatttgtgctctggtccctttgacaggaggtcctggattagtcttgttcgaggagggacccaaacaaggtactgatgaacagatagtctttcatgaaggaggcagagcacttcctattttcaccattatgagttttggctgaactcaactgctctacacacttaattttggctgtcatagctaaatttggggtctgctccccacttcttttttagtaggatgcagctggggaaaggcagcaggcaacctccttcatctccagtttcccacatgtctgagaattcaacttggtggccatgccaagatatgctggctccatgcaaggatgccttgggacagtgtcccagagactgacggagcttccacatttggctccctcttagccgttcccatgaagagagtcacagagcctacaaaactgccacatatttgagggctttccagtagattccgtggcccttttgtgttggtgtcaatcctttaatgagttaatgctgtgatggagctctagcttgagcgtagggcctcagattgaggagcagctgggatgttccatgaagatcgagacccgagcttctgattttcaataactttaaacgtttaggtatttgctggtagaatctatgcttagatggctgtcgtcttaagctcgatatgaactcagagctgtgattgatgtcctgttgggcactgccctgatttaataactagcacgcctgccttggtttcagaattcggatctgctgaagctgcagccatctcagttggtgctggatctccagctctcgcttgatgtttccagagagtcacaggagcctgtggagtaatgacaataaaacccagaaaggcagccgctcatctatttaacgaatacttattgagcaccactgtctaccaggtggtggcggaggtgctgggtacagcactgatggagacgcaaggagccagagctctgcccactaggggaccagatgataaacaaacaaataagtcaggaagataattatccgacggcggcagttcgagccatgagaactgaaacagtgtgctaggctagaagtgactcctttccactgagtggttggagagcaagcgttcacagacaggtagtggctgctgtcatggctctaaggtggccctgagcttggaatgtttcagaagagaaggaagggcattgggtagagtggagagggaatgcggggggcggggagcgggggtgggggcagtgaagatgtgctcagagggctaggcagaatcaatttccgtaagcaatgatagagtgcattgggctgttactcttaacttgggtttgaagcaggggaggaacatcaaggttcctactttacagttttttaaagatgacttgggttagccgaccatgtcccagagttggggtgagggatggaagagaggggtgggagaagaatggaagctcagtttgggagacccctgcccaggtgagagagcctcgtggcttgagctaggatggtgccagcaggataaggggcagagggtctattgcagatgtggacagatttgagaattgcttgggtgttgagtggacacgatttattgatgggcttgggagcactgcaggaaagagtcatcaaggaaaactcctgggctaggggcttgagccgttgagtgaatgggaatgctgcttaccacatagggacgccctggggaaggtcagattcaaggagaagaagcaagagttcttttcggctgtgttacacgtgaaagaccactagacacacaagcagagatgccaagtaggggtttggacaacgatgctggatttcacaagtcagatgatatctgagcatccttcagatgaaatcactggagctccaccctgaatagacattccgtcctaaggatgctcagagttgaggtgggctgaagttatcttactcttctcctgaaatcatcagagttctcgcttttgttgaggtgggtcaatacagacagactaagcatcctatatatgccactgcccttctgaatcttcatcctgtatgtgaaacacgccttttatgcagtattttatgcccctgaaatcactaatttgtggaattgtgtgtggagcggcttttgctgtaattttagcattacgtgggaagtttatgatgaatcaacacgaactcccatataatacatggtagacatttctgctctaaaagacctccagccaccccaccaacaggccacccccaagcttataggctcccttttgttctctcctaagtcacctgagttcctctcctcggaggaattcagccactacactctaaggtccagagcaatttagttctttcctttcccaggttgagcctacttttgaatttacacagactaattaatgtgctctgctaaacaatgggccaccgacttcaggtgtaacttccagcagcacaaagaactggtagaagcttaaaatgattcagtcctctttcatagtctctgagaagcagaggcagcagtaaaaagacttatttctcacttctgtgaagtctgtcaccccaccttacagaagtgactacagttggattcacagtgcacatttgtttcctctgtgttaacgtaattatagtgtagccactctattttccaagagctcctttttttccctatgcactgtgccaaatgatttccatataggatcttatgcaatcctaccacaacactgtgctataggacatcttatgagtccattttgcagatgaggagattgaggctcaaagaggttatacagccaggggcagtggaacctgggtgggagtccagcccaatctcttaatgaagccacacaatgtcccacagggatgtagtgtgtagatgctcccgctgtgggactgtaggcgtcataataatgtacttcttggtgataattatatgaagacaattgccatggtgatgatagctgagacttgatgcttacctaataggtattttttctaagtgttttacacatgctaacacatttgtatgcaaaacaattgtatgaggcaggctctagtattattataccattttacagctaaggaaactgaggaccagaaatgttaggtaacttttctaagatctcagagtgaaatgattggtgtaggctggatttgatcccagacagtctggctccatgggtcacgttgagtggggttggctggagctaagaggattgggtgaggaggcaatacaacccactgctccgcccccagtgcagagatgtcttagtcacggccctgagaattgataaacgataaccagaacaaggtgggcttttctggacagtgtttccctaaatgactaccccacccctgccctaaaaaacagagcagcgtggctcacacctgtaatcccagcactttgggaggctgaggcgggtggatcacctgaggtcaggagttccagaccagcctggccaacatggcgaaaccccatctctactaaaaaatacaaaaattagccaggcatgttggtgggcgcctgtagtcccaactattctggaggctgaagcggggagaattgcttgaacccaggaggcgggggttgttgtgagccaagattgcaccactgcactccagcctgggcagcacagcaagactccatctcaaaaaaagaaaaaaggccgggcattgtggctcacgcctgtaatcctagcacttcgggaggcttaggcgggtggatcacctgaggtcaggagtttgagaccagcctggccaacatggcaaaaccccgtctctactaaaaatacaaacattagctgagcgtggtggcacgtgcctgtaatctcagctactcaggaggctgaggcaggagaaacgcttgaacctgggaggcaaaggttcagtgagccgagattgtgccattgcattccagcctgggtgacagagtgactctgtctcaaacaacaacaacaacaaaaaccagaacagcccactttgtacgtacctggagtaacttgcagtatgttatttgggcacttttaaatttttatggctattgttggaagatgaaaaatcagtttccatctgactgttgcttgcaagtcatttttccatatattctcccatttatacacaaagaaatggaggcccagggagagtaggtagtctatcctgacccctccagatctagatacacacaccttcccagtaccccagggtcctctccttgtcccaccacggggcttattacaatgtattcaaatttcctgggtgactcatctatcctcttctctataccgatgagctccaggaggacgagaagagtctcttattccctgctggagaccctagcccagttcctgacacacactataaagtttaatgcatatttgttgaatatgaaaaggattgaaccaacatgtgacccctcagcaaataagtgggagagccctggttggcaccttggtttccatcaccgtcaacaacgatctcctttgttgaactggcctcttttctgcccagtaccactaggcagggggctggaatggggccaatggtcgtgcctgttggcaagtttggagcaagggttactcagaggcgttggtgtaggtgaacatttccagctctcttcatcctcttctcagttaagacccaagcacagagctactaactcgctgcagtcccattcaacccctcgtagggttctctatgccaatgtgaacggcactcagcaaggtcactctgtgtgccttccacctgctgtgagtttatcatttgttgtcggctgccctccaggttccctgagccatgccgtgtccccaaatctcctgaccctctgtagcgtgcagcagataacaaacagcctctgtaagctgagcaaaggccccagttaaacacctatggcctagggcagtcagagttctctatagctcaaagtggcaggcagaacttctgcagacaaattcctgcttcaggtgggcaggtggagtaggtgtgttattaaaggagggaggacctttgaatttatactcgtctctgtgtccacgggcacaaggcagctcaaactgagcagcctcgggtaacagagcagaaatgaatcttatttttagcatgcactccatgcctgatactatgctaagggatttacagatgaatattaactcatttgcttacaaatgttagcagtagatcacacttcccaaatgcaatgtcatgtcagagaggttgagtaagatgtctggtgtcacatagctagttagtagcagagctgggaatgcccagtctcatagttcacactcctccttaccacactcctgggaaatctatggccaaagaattgtgctacttgtgcatgagaaatgaaaggacttactaaaaaagacagacgctgtggctgtcagggaatttatgggtgcacttatagatgattttatttattgatctgtttatttttagcatccactagatgaaaacagtgtagacagcacagcaggtgaaaagatgacatggtttttcacacatgttaaattagtaaccatgggcactgaacagcaaattccatttcccaaaccctggccagctagaaacttttctgggggaagtctcttcaatgaaacatttatcaagtggttttgctctgttgcagataatatttttttttcctatgactggtcttccatccaaatatttaattccttcctgattttataacttggatttcctaactcattctgcctaagtcatgacctggagtaatcggagattcatatatgtttgctccaaaatctcacagataaggggaaattatacaggagaatatccatgtgtaattgacacaaaacacatctgcaggaggcaggaggtatagctgtctggtcattcagcctccatactttttgtactgaaagtgggaaaatgagtaagtacttagagaggagacatagagggaaagggctagtttctagggtaaagagctggtgtgggaaacatctcatctcacatatatcccctagttggaatttgtaggactgtacaaagagagcccaagggctggcctctcggagagctggcaggagagggatggcaacccaggccgtgggccttgcctgaaccctgcacagtggaggctcaaggagtcattcacatctgcccacagagcctacaataaagatctatttcagagaaaaaaagcatacacacacacacacacacacacacacacacacacacacacacacacacacactgaaaaggtctggcaggagcagagcagctgcagaaggcagcaaagaacaggctggcaatggaggtcgataacccgcacggaggaggggcagatgggcaagggggctagaaagaactcgttcccagggaaagcagagaaagtggagtggtctattcccaaggaggccacagcctgcagacaatgtgtagatgtcaccatatgaagcagcaatctcttctgaaaaagcagagaggaaatgtccgccaggctgataagaaaggggagttggggtccttctgcagagcatagaaggatggctccttttggggctcctgagtgtgtttgatgtgggttcctgaggctgatgccccagagacctcaccttggttcttctggggccacccaaagaggtccaggcctatcaataagaggtggccattcattagctgcacaggtctagtgatattcagtgaagatttctcccttctctattttccactgaccgtcagtcccagaaaccacttgacctccaatgtctgggatcttcccagagactagtaagaacaaataacattgacatcattgaaacctcacacttctctatgtgactcagtttctgtcagtaccaggaaaacgataaagaatcgtcttctggtccaaagcaccatccatgtaagtgtttgctgatgactttagctagtgcccgagaggcagcaaactcggagcttggtgaacacacatggacctgatccaagacccccaagccaggggagggattccaggggtcagataggggcgcttgtaattccaccagttctttttctttggttttcttttgttgttttctatagaattgtagggtgggagaggttcaggagacaggccagaaaaccaccggccagtgcgtttaacatctggtgtgggggaaactcttggaagtcagctcagaggatgtggtgggaaaacacctggcagagtgagtgggcttcgacagggggaagcatggatccaggatcgcggaggccttgcggaacgaatctgctggctgcgctgagctgtggctgcccacgcggagggccggcgtggctgggactcgcaggccctggcctccgaccttgttccccatcagatacagggtgagggccagagcgagaggcttagagggggcggcgggggtagggcaggaaaggcgggggtgcctggcagaagccctggctccgggagtgggagtggggaatgggaacatataccttgaaaggggcccagcgtgacctctcgggactcccggacagtctcctcagtctgcggagggtgggcttcagagacttccaaaagagtctgatggaaacggtgtccaaatgcagaggtcacgcggaaggagatggtgccgggaataatggagtgcgcacagggtgagccggcggccaagataactttgtgtcaccaagggctccagaggaagcctgtgggagctgggctgagttacggagggacggggagctgtctgtccccggggcagggagaggaggtgggggttcgcagagaggctgatcaccagcgctccactgcacacctgagggaagacaggaagccccaatggggcaaccagagcagcccaacagagcttccctgctgtgcaagggcaagagccctttcatggggggcacgtgtgtgtcctaggagctcacgactagactggattttaagcacgttaggaagaagaggaaagaggagtctttcttttctttctttctttccttccttcttttctttctctttctttctttttcttttcttttctttctcttttcttttcttctttctttctttcctttcttctttctttctccttcttttctttcttctttctttctccttcttttcttttcttttctttcttttgaaatggaatcttgctctgttgcccagcctggagtgcggtggcgccatctcggctgactgcaacctctgcctcccaagttcaagcgattctcccacctcagcttcccgagtagctaggattacaggtgcgtgccatcacgcctggctaatttttgtttttttagtggaaacttgctttcactatattggccaggctggtctcaaactcctgacctcaggtgatctatctgcctcagcctcccaaagtgctgggattacaggtgtgagccaccacacccggccaagtctttcttgaagaaagacccttagggttaaggaccccacatggggattctagtttctacatttccgtggacttcgggcctgccttccatttccttcagaagcagggcatcaccttctctctggtgtctgagccttctgctttaagcaagagtaaagttaggcttttccacagaaaggcctcccaagtctctgtggaaggactcactgggtgacctgttcatttcctagggtcctttgtgcattaactaaaatcctttccatcagtaagttcattgctgggggaaagaatgagggtaagcagacttcttcaggccagcaagcttttcttctggaacctggtgaatgtaggaagtctaagggctcggcccatgtccacaaatgaactggaattttatgccttagtataactaaatcctatcacataaaaattgaatgctggtctttgccaacaccacttactctctctagtcaggcagcaaggttgttttgaactggtttcctctgagctgcccaggaggtgagcttatgtagggggcaacaaaataagcagagatggtcctaggacacctatttttgcataaggaatagacattctgaggagagaaagagaagatcaggaaatgatcttacggataacacaggattatttcccgtgttggggattgggttgatttctactagtggaagtggggacgggtaccccagatggaggaaagctaggacacagatgcacagcacgagctcacatggttgctcagaggacagtggatggccagcctgtccatctgttggatctatttaatgcatttatgaggataaagcctggggatttgggccaggttatcagaattctcaaatatcagactaaaaactgtcctgaagacatggatactctatgttaaggcctattgagcacctactgtgtgcctcccaactgttttaaacacttaatctcttcatttaaagatatcaaaactccatgcagtaagcactttaataataaccgtaacaataataagggagaatccttgcaggtttgagcagagagcaggtgagaggaagaaattggcatattccttcccgaacttttatgggcattagctccttcgacacgctccaaatgtacgactgtacacatgatttcactgaatcctcatggcaagtcaatgaggtggatattttcttaatttcgctcatgaaaacaacatttgagactggtttagtaaattgccaaatgcggcctctgaggatgtgtccttgagtgtgaatttatacccagttctgtctcattccaaagccatgttctttctcagtccccttactctgatcctggtgtttgctcccaaggtccccttcctgtcctttcttcttttcttcgtgtctgttgtattttggggggtgctgctgcctctcttttatagaccaaatgatgctctttctccttattctgcctgaagcagctcagttttatcttggacccatggttgtaggtagctgtcaaggtcaatggtgtgtcctgcaaatgggtgactgggatcctctggtctccccttctacggttcaccctgtggtcctcacaggtgtttctcttcctgacctcaagactttcagcatggagctgcatctcatggctccagtgccctgcaacctatgtcttggcccagaattctggtgctggaagggacagcctttagcacattgtgctctgcgtgttctggtgagaacatgacatcacagggacggcttgggggacagagccagatgccaggaatgagaggccaaggcagcattcctgggtagtagctggaaaggaagggcctctggggagattgagaggtgggatgtgaccctcatatgggcactttgaagagggtttgtcactgtcaggccagaagaggcagaggaaggagggggcccagcaagttgtcagagggacacattctcagtcggagcctgagattcatctttcagcacctaacttcacaattccagatggctctccttggggagttctttttctctttattcttggctcaagcagtcactgcttaatgagagccagaggcactcttgccacgggaaaggccaacagaatatagagaccaggaagtgggtatgaaagggcaggcgtactgtggtagggaggctgatgttgggagcctgggtgttggttggtgtctgagctcatggcggtggagcatggtggggtagcactggggagcagggacacttctgaacttcagcctcagcttctgaacttcttgtgtcaggaaatgtgaactggaaattgccccagaacagacagtcctctgctgatcctctctcttcactgcttccagaaacagcagggtgtcttatttatatgttcatcttggtgggaacacagtgtctcggtgtcctagactgctacctctagcctaagggtgcacacgtgccccagagtgggacctgctgtttgctgagcttcttcagagctgaccacggaggcactttgtttagaagtctggggagccggagactgagggttaggatgtgggtctcagtactttcctggttcaatacgatcttggttcctcgggccattctcggagccaggacataaataagtctgttcttaggaacttcctggctcttttcccattctcactcatctttcctttctttttgccactcccccagattcccttcttcctccctctttgcagtgttttccctgctaaagtctctagcagtgcttcagggggagttttaatttatttgcccattcatcatatagttagtgggtacctacttggtctcaggccctgtgctaggcccagcctacgaacttgagcaacacatgccttttgacttttggccttttgacttgtgcaactgccagcacccttcaaagcctctttgtaaaaatgtcaaactctgaaaagaatgtgtgagggaagccctaatccagagaaggcctagggacgaggcatggactggccagcagaaagatccaggttcttattcttaggtaaaaaatcctgagccaacctggtcccagggcagcaacaggaacaatcagggctggtggtcattcaacctggaatccattcccaagtcattgttaccccatttgactaatcatttttattttttattttatttatttatttttgagacagagtcttgctctgtcgcccaggctggagtgcagtggcgcaatatcagctcaccacaatctccgcctcccaggttcaagcgattctcctgcttcagcctcccaagtagctgggattataagcacatggcactgagtgcggataatttttgtatttttagcagagatggggtttcgccatgttggccaggctggtcttgaactcctgacctcaagtgatccacccacctcggcctcccaaagtgctgggattacaggcgtgagccaccgcacctggccttgattactaatttttaaattctagacctctaaaaaaattctgcagagtttttgtcttagatctccagccttcaaaatgtcttctcttagaaaggtcctttacaggaaaccaggagatcctcttttttctcctagtctataaatcatccagggatggctctgcaggagtggtggtttgaatagtttagccatgctctactcttctgtccaggtggagaactgactgggttggctggagacccctacaaagggcctgtagctggccagggcacatgtttgtctggctatgctcttatgcaataccttatgcaattagctcctcttgcttgccattcatagaaggcgtgaggtgagacccagccaggaggccaggagaaagtgtgagggcagttctttgagggctggcagaaatttatatcttgagcccaggcagggccctgccctcttggtggtctccttccccctcaaaggttcaaagctggccctctttctccctcctgccacttcaaacacccagagttggagctcccagaatgttattcttttccatttaaagacattccatttcatgtgtaattaaatatgtggtattgaattaatgttttcttctgagcctttttggcagccagagaccctagggtctggttagtgcagagaaaacacacgcttctcacagatcctcccttcctctccctgttttctcttcccccttctctcctgccaagaatctccctcctccctcctccctcctgcgtgtagtcacgctcaggactcaccttgtaatgggtgagcctgaggtcctggaaactctgtttctgggtggggcagcaaggtcttgggtttctgcattctggtgctggctttatcttcaaatgtcatcctggtggctcacattgagcttaggtggtggcaatcaagggtaggaagaataggttccaggataaagtgacacactctctctttacagatgttattggtttctaccaagtactgatgccagtgcagaaagcagagcctctctctgaagtaggggttgcaggggttgaagggggctgtcatgattaaaggatgtcaaggtggcacagtctgctcagcccagcctttagagtcccacaggacacctctaacagctaggggatcttgggcaagttacgtaaccacctggagcttcagccccctcatctgtagcacggggacagcaacatattgtgtttaagagacttgtagggccgggcacggtggctgatgcctgtaatcctagcactttgggaggctgaggcaggtgaattacctgaggtcgggagtttgagaccagcctggccaacatggtgaaatgccatctctactaaaagtacaaaaattcaccaggtgtggtggcacgcacctgaaatcccagatactcgggagtctgaggcagaattgcttgaacttgtgtggcggaggttgcagtgagcccagattgcgccattgcactccagcctgggcgatagagcgagattccatctcaaaaaaaaaaaaaaaaaaaaaaaaagaacccacgaaagacagagctgtaaaggtatcatgtgctcagcctggtatctggctcaggataagtgctcaattgatggcagttatttttattattaataagggcacagagggataacaacgagctaaaggagcagtgcagagcgagatggaatccacaagggaaagatctgtgaggtctcagtgatgaggacaggaactagttaggaactgagtatcaacatgagccagggaagaggggagggcaggatggttaggagctgccaccaggggccagccctcagggctgctggtggtggcaggggactgcttctgagcctcttaagtcaacaccttcagagaaggactgtctcagtcctgtccacacacgtggtccccaagacaataattagccaaagcaccgaggtagcaaacaagtttcttttaaggcaatctgagtgtgactgagtgcacacactcacctttggggaccgaatttgctgcttggcatacagcaggataactgttatttataaccaccgaccctgggaaatcgggtttctctctactgatcaatgccaatcttgagttggtggctgtctctgccttttgatgtctttattccactgtctgaccaacctcctcccgcaaactgttttggcctctgaaggaggaggaggtcaggcatggtggtggcagccgtagacagagctggtgacctctgagccagggccagcttactcctgggcaagctcgtgccattttattttaggagaaaatcatcatccttctccacatttcttttcaagccacgattttatttgcaagataggtattgagctcctagttgaaatgaaaattggaaaggaaagaaaaacatctgttaaatgtctaatatattttagatattttatatcatctttattatctaaaaattttaaatcatcctctgaacagttctgccaagtcaacatccatgttcccattctacagataaggaactagaggtgtggagaggataggattcaattagtaagtaagagggtcaggatttcaatagagatctggtttttttttttttttttttttttttcccagtcttcactctttcagcagtgccatttggggcagattttttgttccctcttcctccctggtcgcagggctgagcagtttatgcctgccacctccctgccctcattctcccagaacagggaggtgaagctgacagtggtcacctctgtgtccagcgatgtcagtgtatccagcggctctgtgtatacctcccctcctgccccacagggcagccaaggggaacagaggtaggatgagggataacccctgcctgcccactgacctctcagggctctgagattttctgtccagaggtgaccagttacctcaatggattagagattctgctctaggtcacgcttgctgcaggctggaagacctcccagaagtgaatcccacacatatggaatagttatcttggtccccactacagagaaagaattcttggagcagccactaaaacacagaaatcttgtttctgttcttgtgtcagatgaaccggttgtcctgtgggaacaagaagatctacaggtggcttcctctggtggaacccagttggtggctgtctcacaaaaaggaattagggaaaagccaggccagaaggtcccaggaactcttttaattttccaaagaacccttcccattacatagcagcctcctgctttctccagcagccccttttttgttggagattgggaggtcttcccacggcctggggtattcatccccctccctgcctccccttccagtgtctccatgtctgagccttgtgacccagactctgctgggccagccagccaggcagtaaaaggagattgatgccctctcctcttaggaaaatccatcactttttggcctgtagttcagatagcttcaccagaggcagctctgaacagcactgtgtgagctaaaagcatgcagaagcagggacccaaatagacgcgtggacgtcagaagtgaaacggctcactccagtcattccccagggcctgagcagaggctcttcctcccgcactctgtccccagatacactcttctccccagggctttgtctgttctgtaaggcttccagcgggggctcctgccctcgcccttgggaagatgctgtcatagaattccaggatgagcagagtgagggaaagttgagtagtggaagatggagggttaagcctctgtgaactggatcattttagtggccgtaaagctgggaagacagagcgaaggcagcctaaggtaaaggaaagaacacgggtttcggagtcataaacaagagagtccttctttggcctcattttacctctgtgaatttggcaagttaccccctgcctctgttttctcacctgtgaaaggggtgtaataacacttatctctcagtctctcaggattatgatgagaatcaagtgttgaacacacagtaggtgttgaatacatagcgtgcaagttaattccctttgccctactgtttcctcggtaagttcagtgaaagaagctgctcatatggtattctggagtctccagtcttgttgatgcatggggttgtccacatggaagtgatttgccttatgtgtttggcccaaatccagccagtctctgccaaagctccctggttaccttgtggagcttcttatcctcatgatgaggaaccagtcctttcctggaggagaatttatggtcgaataaaatctgtgcttatttcccattcctccttcagctccttcccagcactcaccaccctacccagggctaaggacaggtattggtgtcagaattctttcaccctgaagacaacaagaatgagccaaggctattttcttctgagcacctgagtatttccacattctggaaaaagttccatttgcacatttggggaagacactttggcccacggaggcttctgcttgggctttttcatgtgctcacagagagcagatgagcttccagtaatatggtcacttgccctctgctaccttcaaggctcacagctgtcacagcttccccactcctgcaaccaggggtttgcagctgctgccaggctcttctgggatgttgagggagggctgagaaaccactccctggatgctgctcccacttggcttgtctgaatctctcaggggttgtgattcttgctgccgagggaaggagaggagaaggatggattccaagatgtgaccgaggcacagcagctgaaaaacagagtctggttctctttaaagttcctccattcccattttgcactaattgtagctgggagtgagtgttctgagtggagctggtgaggtctcccagcccagagttgtacttagggacccaggaaaatctatattgttttgccttttgtagagatgtttctagaacataagaaggcaagagaggcatgatctgcactgcatggatgggtagttgggcctctgagaagggacttgactcaatctaggccacacagctaaggagggaaggaggacctttgagctaagcccaggacgtctcaccttctcctgggcttctggaagtgaggcatggctaaactgtttgtgagcatggtacttgtttaggccaagttgtaaaggtaaacttcttcagctggctaatttcccaccccaccaaagaagccgtgttctggtgattctcaaagtgtggttcctgcaccagcagcacctgggaacttagaaatgcatattttcaggcctcaacctggacctactagattggaatccctggtggaggagcccagcaatctgttgtaacaagccgtctaggtgattttgacgcattctcaagttctcctattacaatgcagaggaaaggtgggattggggtggagtctggggccaaacggtgctcttccccaagtaacttggcaaccctgccatgtcctgatgctctgaatcccatgcccagctcagtcaccaggtgcggatgcctgatttggccctcatttctcctttttgtaaaataatatcaataataatgaaaatgccaaaacacagcctacattttggaggacttaaaggtttacaaacttccatgctcaggtaataggtaagttaaactcgtactattctccccatacccattttacaggtgagaaatctgagacccaagatttcatggttgttgtttttctgtgaggtgcataagctcttggaggatccaggtcttgaagcaagcacctgtggcttcccaggccttcccaatcccggcgtgttcagagatgtgggcttgacattgtacagctgccatcgtgagccctgtcttcactcccaggccgtgccaggacactcaccttgcagaacctatgtgtcatccctagtcacctgggaatgattaggtagcaggagcaggtggcctcccgagagagggcctgacttcctattttctcgcagtgggagactctttagccttgccctccaaggtcaacaaataccattcctcagaggctgagaaacagagacagaaagtgtgaagaagggaaccagttttaatcccctccctgtaaagactggggcatagccctgcagtgtgtagcagccgcattgcagcctgtggcttgggaggagcggtcgtcagcagctgttaacgtgcaggtctgtcctagggggaggagaaaataatagtctgtaaatgcttcctctcgcaaatccttactaggcagatcatctgcgacactgtggggataccaaggactctgaagggaggaaaaagattcctgtagtttattcttaaaggaatccccaaaccaaaaaaacactaccccaaggcttccagccatgcccctctgtccctattacgtctcctcatttatggggatggtctgccatggcccaggatctgcagctttcatttctcgacaaagtcgcttgggataatccactttttggctcagcaatgctcttcaaaatgtgaatacaggtatttaatgggcttctgcctgttgaacaattaatgtaaaggtcagtgagtaatctcctgtttgctcttttcatcgccagcccactgcttgtacaactccttcgtagcattctttccaaataggtgggagggctgaggtcacagctctgctttctccaggcacacagaccttaattaggttgctaaattagcagaggcaggggcaacccttctctctgcacacaccctcgttcttggatggacagtgaactttccttttgtgatctcattggtctttctctctttcagagaagggttggccaagtaggggtttcccccagataatcttagctacccgttagtagtctctgtcatgaaccaggcactgtgatggggtcactacagcctttatgttaccacaaaaaccaatgtgtctttgtgtgtgtgtgtgtgtgtgtgtgtatgtgtatgtgtgtgtgcatgcgtgtgtcttgtcttctacgtctttactttgtcctcatcactgggccaagctctttatatggattatctcatttaatcttcacaagaattcagcaaggaagttgttcttgttaatcccattttacagatgaggaagttgaggctctggagctaaataactttcccaagctcaaaaaactagtaatggcgtggacccaggattccaacctgattctcaatcgtaccctggaaaatttgcttttcaaagtatgaccaacagcagagggacatgacctgggagtttgttagaaatgtagattctcagacccactggattagaatcttcattttgacaagattcccaggggattcatgtgcacaaaactgtggagactgctttgtgctatctccaacaactctggctaatgaataccagaatcctgtgcattaactactaactccatttgccagcagaggatgttgtggtttagaggggttaggagttgttcagggacagcattgagatttgattctggcccatactctcaaaccacagagggatgtcagtttttatgctaaagctggtgtgctagagtttgcctttgcctgctgtaggctcagaaccaagttctccacgctagacctctgtactcttctgtctccctgtgtcaccaaacgaggactgatttgctgccctcctctttgtccccatcctacagatgtgcagcacattaagaggagagacatcgtgctgaagcgagaactgggtgagggagcctttggaaaggtcttcctggccgagtgctacaacctcagcccgaccaaggacaagatgcttgtggctgtgaaggtaaaccccagaggcatgccggcaccaggaggagggctggctgagggcccagggagggaaggaagaggctccctccatttgagaagatagtgctcaattggctttctcagatgcaatcaaaggactttgctccgaggtcaatgaagtttcctagggaccaaaacaacttcctttggcttccaaggtcaagggctgcagcacttaagggggctatgccaggggagcaagtttattcttgtaaatgaccctggtccttttttagtggccctgtggttacctctgtcccaggcctggccctccacactccacccttcaccatgtagtggctttacaggacgtgctgtctgtgcctggaaagtcacatggccatttctcagtagctgagctgttgtagagcaggctgattaaggaggactgggtaaccacttcccaagggcacagaagtcactgagaatagatgttgagggaggggggtgcagcagggaggtagggggttagcactgggagaatagtgagtgaggttggagaaattcttaggtacttcccatgggtttcaggttcagaccccaaggggcagcatgcctgggagaaacttcctcctggcagctgctgaagggctcccttaaccacagggcttctgtattgccaagacacgtggcagatttgcagcaggagctgaattgcttggggtaggagagaagggactttgctactactagttgtccttccagactcttccacccagcagtcaacagcttctctttgtaaaccaatattggacaaatttttgaacatggttaacataaaaagagtcaagtagcctcatggaggcacgcacagatctctggagcccttctctggagtctggagtggcttcattgggtgcagtgagcaggcttctgaggccagtgtagagcctgcaatgtcctgagatgtgggctgaccgatgccagagatatggctccccgtgaagacattcacccagacctcacaatggtcccatccttagcattgagggatcacaaatgcagttcctgtttcttcaacttttgggtctctgtattcatagtcttgtgtatctacagattgtttctgtccacagagggcaaatagcctcgaagaatgaaggcaatacagtgcaggcatagcatgggcatcaaagagcctgggtgcaaatcccagttctaccactgataagctttgggacatttcacaaaacactcaacttctttgggcctcaatttccttatctgtataatagcaataataatatcctctccttagaatgttggggattaaattacataatgtgtctaaaattcttaatgcacttcttagggctttttattgagtaaagactcaataaaaagtagttggcatttgtttctatcattatcattgtcattgatgttgatattactgaatgtgcttagatacatgacatatgatctgccaagcttgcaatgactatctagaataggagtcaccaaactttttctctaaaggtaaatattttagactttgagggccttataactctccattgcaactcttcctgtgttgttggaaagcagcataacaatacattcactaatgagggcgggtattttccaataactttttttattaccaaaataagcatagtttgctgacctctgctctagaaaataaacaagagtcctgcatcctaaaaggctaatgattattattgctgtacatcctgtaaataaacttgctcagtgtgcctgcatagacatgagatggtcagatggacaagggtgtctttaaacagcttggagcagggatgtagaaaggtttctaatgttgaccctaaacttaggatctgcactgccctggcatttttaatatataggatgacactaatccacggggtgttccggcatccatctggggactggagaatgaactgaacatttttgcactttcagcagagaatgaaatgatggctgaaaaccctaggaaatgtttccccgagtggtctggcattaaggggcagtacccagaccgagtaatgcagaaaatgtgtttctgtttccatccttttaaaaggatttccttctttccttggatctggaggagatgaaccgtctgggattttacacgtgtcactcagtggatctgcctagtggtcagcctggaaaagatgcctatctcctccagacaacgtcttggaagtggtgtttcctgcttcctcccctccttagattccacttctttttgcaagacccttccttttgagttagttctcatgttgatgcagagtaattttatacctctaaagaacacatacaagtataacccacaataaagttttcccaaatcaattggcaaaaatgttttgcccagcagttgctatggtacaaacaaagaagcagaaaccacagcctatttttaaggtgcttacagcctgctggggagagggagcaggattgcacaggacataatctgcacatatgtgtagtataagtgtgacattaaaataacctcatgtgtgcgactcttaaataagtggtgccactctgaaatcatcattagacaaatagaacatttacacagcattcaaacccagtcaacccccttcctttgcagaggagggaatgagatccttctccccatttttcctttttttttttcgtctctgtcatttcatactctgtcccgggtgaacctcagtggtcttctgattcatgaattcttcatgtggttttatctggtctaaagcttttcctgtctgtggaggtttttgctttcacttcaaagaccatatcttttatttccaagatatctaatcggttcttaattttgttaccttaattttatttctcccccttcttgtggcatgccttcttgttttctttagaaaatgtatttcttcactccttttgagcatttacttatttaaaaatctttttgagccattctaataaaattgatttatcttcaggaaatttatgtcctgatttttgataatattagtcatttggatttagcattatatttcttcctgcccagcacccctgggcagcttttgggttccttttggcttgaagggtgttttggtttttgttttgagtagtcacaatttctagtttcaattactttaaattgaagcaggagcttaaaacatttgtgaaacaatctgagtgcagaatctcggatttttactattttcccaatgtttttatgctttttccttccactcttaacagtatttttaaccactgacctttagcaggttttttaaaagcattcatcctagcttccataaaaactctccaatctacattcatatttcattggtttctagaacatttcattacattaagtaattacattagcaggtttagttgtcatgaatgagtttgggaacaatcactgatgactcttggtaagcccctctgtgggaaagtagtatctccctgggtatccaacttgcagggagtgttcaggatctcatgttctgtagaggtcataaggagtgccagctaatctgggctgtcatgtagacacagctcagtggagagttttctggcaaaaggaggagcaaaggccctggggcagagaaaatcttggagagtacggaaaggccatgagactgaagtgtaataaatgaggcaggaggagtgtgtgcgaggacaggacgcaaagagagatggggagaccagaccttatagagtccatgactatgttaaggagtttggattttatactacaaacactgggaagccaatggccagttttaagccaggaagacagataagagaggggcacccctgtatgtaataactacccatcttctttcctggtaaagttgtgtgagactctcacccagaggaagtggcagtggattttgagtcactaaaagaaagatgattttataatgaaaggaggttgataggtgtgcgtgtgtgcgtgcgtgtgtgtgttttaccacttaggactttgaacatttaggaatgtgtgtatatcatgtgtatatcataaaaatgaatttcaggatattaatgaaatctgaaactgaacattctttgaaatatctccccctaaaaaaaaaaaaaaagaaagtaagatggagggcagcagggtttggatgacatgaagatgctgaatgacccaggaagagttgggagctgtcgagaagttgtgttcttgccatctagcctattttccttccatccaaataaacagccttactgaaccctctccccaaggcagagtggacatgacagctgatgcacgtagaggggaagataagaaagggaaatgtccccaaactttggaagaaagagagggagagaagaagggcaaattctagctctcctttttgtactaaagatactatacaaacgcctgagccaggagcctccccagcttcagagacctcttggcaagatgcatgtctctacactgatagttggtaactatgataaatcggttctttcccatgccactgactggtgacccattttgaggtttcccagacatgaagatgttaaatgtggaccccacggagaggggccagagagtcaccggccctattttcctcctcattattctcctcctgtcacctctgttctaattgcatcagtccctggggacagggccactggcagctcccaaccctagttgccataccctacgtttggccaattaggtaagaacttcaggtttgactcaagagctggaaagcccactttgaaagcacagagaagggatgtagaagactgaaagtaatggtggttgctttgtgcccatctcccaaatgaagaacccatctctgcctcacagtgcagggtgccagcctgggggatgcttgctggtgctgctcaagagctgagaacagaaatatcccagggctgtcattgacgtccagactgtgggagagaatgatttaaagagatggagagaggccatttggctggccccaaatttgacctacttttccctctcataaatccagcattcacataaatctttgtattctcccatcccacccatgctgggttcagttttttccccttcttcttcttcttctgcatgaaaataaataaaccactctgcatcattcaatacccatgacccagcccatacagctcaaggctgctgctgggagctgggtccccagaagagactgtctttcaccatgactctctgacttctcaaatgtctttgttctggctataggtagacattacatcctattcgtttattgttaggtagcttcccagagcaagcagccagatttgaagtggagaacacatagaatgaggtctggtaaaaatcaacattgggctgatcacatgtccttgccctatcctcaagcctggcacctttgctgggctcagccactctgttggcagccaacatcccacccctttcctgaccctctcttctatacttccatgtccttttattcctctgcccaccattgtcttggggacctgcctagtgactaatttatcccataaattaattcaggcaggtgtgctgggcaggaaagtgtcctgggctccagactcaagctgttacttgttacgtgatctttggcaagttacttccccatcctgaaccccagttatctcatctgtaaaatgggaaagttacactagataactttcgacttttttgtcagccgtagattaatttaatcaagcagtatttttatgaagcctccaaattttaaaaagaatagaaggtggtgctggttgaagttgaagggggcttgatctctggctggaagaccacacctccacttgatgaccttagaggcattgctactgaactttggggcactgtgaggcccaccaggagagtactgaggtccagtcaaactctaagtgtctgtcatttaattagtgtgaatgtgagctgattcctggacaggctcagcctcagtttctccaactccagaaatgagcaggtaggagtagatgatgtctagggcccttttcatactaaaagtccatcatttctggtgtgtgctaagggctgagaggtttgatggacccccccagatacacctcttttggcatattcacactactgcagttctagaaccaaggaagccctacagatttcagataatggggctgcagggacaggagaaagatctctggtgagggagacattttggcacttgcatgatctataggagaggtcagtcatcctgaaaaagccagatgcctagcagagagaatgcaaaccaatctctagtctgtctagattgtcactcccctgaaaatggtgagccaatattacactcacttcctcattaccttgtgttgtgtctattgagattgctaaagtgtgtcagttgaaacaactcaatgttgggccccatttgccttctggcctcatagggagggtggagaggctggagaaatcggggcgcccacctgcataagctgctcctcatgcagaaagggcctctcctcttcacagaccattttccatctggccagcattgctgggcccatggcagtgccctaaccaaggtccttcagatgtgctcaaaggcttcatctttggccttgtagtccccttctggtgctgggaaatccacatgcacaacttacactctacctgggtatattcatcttcctgggccctacaggaagtggcctggtttgcacctctttctcacacttgagttttcaccctgacagaggctgaatggtggcattctggtggcccccagatgctcctttccatcctgcactaggactttgaaggactctgcctggccctgagtgtatctgagatttctgtccactaactgccattcccgtagctgccgccccactcttcccaccctattgcttcctccaaacccctattgggagaacacaggtgtcttccagaggtcaaagtgctcactctcctctgcaaatgtagataccttcacaatctaaaagcaaggactccaaaagacaaggatattttattgtgttgcctgcccagtttccaataggctatgagcatgtgactaattcacaaagctaaagtattggggcagtggttttcacactgtttattccagctgtgggacagtttcctcaaagaaaaccttaggagcaggggcttttgccaggctttcctcctcacagcccctccagctgccatgtacactcacctgcggaagcccagggctctgtgaagaacagagcttgaaatcactggagagtgcacgggatgtggatgtcagaaagtgggtttctatttctgcagggatgaaaatgctggagaaggaaggagtcaggccttatagttgagattgagcttcattgtctttaaattccatttagattcatatttattggtaacccagtggtgtgtggggccagtttctttccaggagtagaaaagacagccccctgccctgtagttgttaaacacctgtgtcctgcattgttcctaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcaggtaagcaaggattgtcttcccctgcacctgaccccagtcccaccgaacccttggggttttccctggagccagaaattatactaccccctctaaacactttcctctcaggatgagaaattagatgaacacattcattcttatacatgatctccttagcagccagattcaggcctttgtccccggtttgtagggaaaacaagttgaggatactatgataagtatcctatactattcttcctcattccaaaatggacagggtctggaataggtccagaaggagtctggaagccccacagcctgtggcttacaactccaagattctagggccacccttctctgatgttgcaaatagctttctccctttgtgccttaagtttctcacttgcaaagtgaggctagtatcttacacccctcctggaaaccttcctgctagagactttttgatgatgagtaagaaggtccaaggttacaattcatcaggtggcagagatggttgaaacaaaaaggggaccgattttcttcaggctaattctagaactgtacagtacagtgtccacctatggccacttaaatttagatttacattaattaaagttcaataaggtttaaaaattcagtcgcactagttccttggttgcagtagccatatttcaactacttgttagtcacatgtggctagtttttaccatacagggaagcacagtataaatgtttccatcaatagaaagttctattggatagtactattctaaaaagaaaggatttgttgtaagaagggtttctccgagcctagaacaagaccatctggacttcgagggctcttaatgtaactggtaagagactggaacgccagccagaagttctggatgaagtttcaagggtggctttcccttcccaagagaagacagcatctattgcagagttaggactcctctgccttctgcagatgccacttccaaacagtgcccagatgtggaagggacagccatgtgaaggtctttggaacccaaggccccaggaagcaggttaaacacacaggccctgtatacttagggtgtggcctctgcgaccaccacaatttgaatctcattgaactctgtggctgaggataagatttccaaagttcaaatgtaaattatagaaggctctagcccactcaccaaaaactgctaagcatcctcttgaagtgggacattcaatagggtgtcgtggttttgaggggcaaagaaatgagttagtaccaggcaatggaatggaggactctctggagctctgcttatgagtcaggtttctataaagatggccctaaaggaaatgaaagcatctgtgggatgttctaagccttctaaacctggattcacaatgaaatggattcctttcctggagaactttgtctttagcataagacagatttgggttcatatcttggatttgtcacatcttagttgcaaattggagcaagttattaaatcttaattttctctcctagaaaacacgactattaataactgcttcacggggttgttgctatgagtattaaatgactatatgtataatgcttagacaagttttgcaagtagttcagtgatcagccaatggtagctgctattgaagttattactattactattttgtgagaattgtgaaccatggtagcttctaatctaggcaacactctttctcaatattcgggatagccctcactttgtccttttgttcccctggggcccaaagggcatgccctacttttcaccacatcctatccttacattcagcagtatctccagccccaagagccaccagcagggttaaagaaagctcctaggtgcctctgcactactgtcatacatgataaaagggaagagaaagaagatagtaggagggaaataaagagtgagagcctagagtaaagataaggagtggaagaagcagaaagtaagaagaaaagaaaaaggagtacagaagaaacagaaagaagtgtataaggtgaggggcagtgccagtgccttgccttctccatggcagacagcatggggaatgcatgcctgtgagtacagttctacaaggacttgctgacactctgaagacctctgtgtctctatgggatcccttcctgaagacagcatgggggagtctctctaaatcaaggctcgacagtcttcctggggcaattttgcagcaaaatctgaactttagcctccactactgaccagattcccagtaggttccattaatctgtcttcctaggctctatcagtcgagggtgaccttctaaagaattctctgagaccagaagctcttagcaacaggccgcaccaacccttcctgggaggcatcctgtcggctgttctcacaaacacagcctccataacccgcaggccaaccctgcctgctctcacatctccatattggtggtgttgagaggcaggctggagtgcactctccaggcagacagaagggagggcttctctgctgacccctcttccttgtgagctgatgcagccttcctccttctgaggagtgaggtaggcagagcccaccggagatagtaaaagggatgtgctcctacttaatggtgcttttcagaggaaatcagagaagcagtaaagcaggcagaggccttgctgtacaccagggctccttggtccacaacttcataaataagggccctgggtgtggttacggctcactgggctttctagagaaaagagtgaatgctaaaagtgactgatatgatcaggcaaggtgttagaataacaaatccgggcttgatttgggatggaatgggttctgggggtaccccagacccatgcttcaaggtcagaggctctctccactgtgcactgctatggccataagttacccagtgctaagcggtgtggtggagtggttaggagtgtcccagggccactgagcgtggactgccagcatcagccctgggagctagtgggagatgcaaatgagcaagctcacctagccaatcagaatcctagggggcagggccagggaatcttggaacaagcactcccaatgttccttttagaagctcactttttacagtcacatgtctggtttcagatcctacttcctgatttcccatatggccattctggacctctgggactttggctgagcaatctcatcattttgtgcctcaatttctttatttcaaaattggggtgggaaaattgagtgaattacaatatttaaaacaatcagagcatatagtaagggctatggcagagttatttgttgttttgctaattattctataatagacatctagcacctgtgaaaatcctaggaagcagtgaaatattaaaaagagtaggtttattccctcttccatttgagtatgtctgctctcatcttagccagaatctggttgtggagtttcacccttacccacacgtacataatctaatttggggcagataaaaataagccataggcaggatggaaagggaaattttatttatttctgtggggcattccagagggcagggacccaggaaggcctttctccttgatctcctgatttctctctgccccctctcttctccccatgctcttgcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtaaagtgactttcccagctgcaggactcagccacagagctagcgccttgcttacatgtctttttcattgtccattaaccctgtcactctggcacacacatatacacacccatgcccagacatgcactcaacagttatcttttggcctctcttgcatcttgacatacctgtttattatgttctcaattgcccactccttctttcttcttggacatttaactgaactgtaatctgtacattgcaataacatatgcattgtgttcttacgtgcttcaatactcattcttcatgtaaacatactcatacatgtatatgtatgtgcccaaacacacacacagacacacccaacttgatactacatttaatgtctccctacccagtcccagatctagcctcacccatgacacattttattctctgaaattatcttgtgattatgtaagaattatcttgtttccaaaagtagatcttgatgagaagaggaaacctaagtaaagtaacaaagatggctaatatattgctgagcattatccaaatgggctggaacagatgaggaaaggaagcatgttatctgttgccaactttggagagaggacaggttagatcttagaaaagctttctgattgtgagaagatccatcctgctcagttttaccttcatatagtcatctgctttacattaacaagagtcttattttgctcctagaatctttttttttccctaagtctttgggaatctttttttccatggattattgactgattctgatagtgttattatttccagggaaaggatgaatggccatgagtgtcacttatctcagcaaggggaagtatgagtgcaacctgagacacagagataacttctgcaaactgagtgagggcagattgctaaaaaatacagaagatccaaggctgggagtggtggctcatgcctgtaatcccagcactttgggaggctgaggtggatggatcacgaggtcaggagttcaagatcagcctagccaacatgctgaaaccctgtctgtactaaaaaatacaaaaattagctgggtgtggtggcatgtgcctgtagtcccagctactcgggaggttgaagcaggagaatttcttgaacctgggaggtggagattgcagtgagccaagatcacaccactgcactccagcctgggcgacagagcgagactctgtcaaaaaaaaccaaaaaaacaaaaaaacaaaaaatctatttttgggacatcaaaggaaagaggagtttggatagacattataaggagagtgtgggacaatgttttggaggtcaagggatgtcatattccttttcagctgttataacaaataccgcagatgggataggttacaaaaaactgaagtttatttctcatggttctggaggatgggaattccaagatcaaggtgcaaacaaattaattgtctggtaaaggtctgcttcctcatttatagatggccatctgcttgctgtgtcttctccatatggcagaagggttaacagatctctctggcatctcttccatatgaatgcattgccctcataacctagtaacttcccaaaggcctcacgtcctaacaccattaccttggggctgtttcaacatatgaatttggggggtacacaaacattcagtgtattgccaggatcatggcagccaattgtctcatctttggagaaatgagtgatcataccgtgagtcaaatagatatgattgtcctgttgacctgagcatagtggaccagaggctgggaatttgaggtgtgtgcaggtcagttctatcttgatgttcctgatggcctaaatgagatcactcagacgttaaaacagatcagtcaagatacttcattttagcaataggttggagaaaaatggaatgtttgagaaatgaccttggttgttagaaaatgacttgtttgttgtgcaaccaaagaatggcagatgatgtaccgttgtgagagaatataagacaaagcatacagtgtccacagcaagctgggtagcctcactagccacctgtcctatccagtattcccaggtatggaaaaggagacatgatgtggcagtagtcatagaccgatggccagggcagacctgccagaaaatatcaaagaggagtctttctttagtgtctagaccatattttttattcatttccaagagaggcattggtgtggttactaagagggggatgggtcatagatttcttagagtggggctggagctggcatcatttaattgcctttccactttgtttaatggggtttgctggtctgtctgactgtgctcagatctatgtaggtgttgatgaaaacaagggatggctcattgtttttctctgtgaaaggcagatgtttgattatgccaagctgataactactgacttcactggagtctcaggaaactatgtctgaccagaatgtgctaactggcccttcaaacttgcttctagatgtgctgttaatatttattgaaactagtttaaaagaggaaaaacaaaaaataaaaagatcacatccccaattgatatttctttgtccttgccttaataactgtgaactgttgctctttatgcctaaaagggctacaaggaatacatctatctaatttctgtaggtgccagggtagattagaatttaaggaagggagagtgaggtgggaaaatgtacacactacaggtaacctcaattccttcttcatgagttctaagggcgatgttagccaaggccagctagctcgaaatgtatgtttttggtcccaaggaagtttgaacaaaaaaggataactcttacagtaaatacacagcacaccattggaaatctgtgtattctactgatgagacatttaaagaccagcttgtggcatatcttcatgttcacttactcacagtgtcctaatgtatacaccactcctcattccctacttttctgtaaaatgaaaggcagaagtagatttgcctgaagtcacatcaaaatgaaccctgaagtcttattatccatattggaagacattggaatgacaatggaattcttggatttaggcctaatcttacctgtgttcacatcctaatgtgcaaccaccattagcaaccatgtaacctgaatgcattttcctctaacctctgttcaatttttctattgttaaagtgagaacaaaaatattcactcaacagagttgtgttgatgttaagcaagttaatttgtataaagagcttgtagtacaatacttactggataaactcctgtttatattatcttactagtccccctcacatccaagccaagacaactctgtggataattttatttccatatgcaattcctgggacagagagagggactccgtgaccactagaagataaactggatcatgcagctgctccaaaggagtagaatctttacattgaccacctcaggaaaatgtctttcttaaggtttcaacatgtatggaaatactgctcatgaatcctagagctaagtccacatttgggtgatttgtgtaaaacttttttgttcagtatacatcggctaaggccttggaggaatgctctgatttgtcagatcgcgagaatactgtgaaggattctctctatgagctgatacccccggacaggtttgtacctctctgctatcactgattactgaactcatttgggcctaagagtttgttggcttcttatgcctaacaccactaagtgcagataatccaggcctgtgtgtgtgtgtgtgtgtgtgtgtgtgcatacacgtgtgcttgcctgcccagtgcagattccagaatgtgcatataagggcatggggagagatggagataaactcctccttatagtctttctttttcatttttaatttgttaaaacgaagaggcaccatctggctcatacataagtggtatacagacgatttacaaaggtgaactgcctaatttcctgttacacatttagagagagaaaacaaatgttcccacaccagaacaccagagcgatttgttctctcttcttaagacattcacaatgacaaacaccttttccttctgtgaatcactgactcaatgcttccaagattacctttacactggctttgacaagggtaggctttgggtaccattatatctttctaagaacatcagagaacactaagagattgatagtcaaatctagtattaaagttttgaatgtcctgaaggggagaaggttgagatttcagaatacagatgttttcagatgttttgatttggggagaggagtcaatacactgagatcagggaggaatggaatgaggggggaatgggatcctactaatgtagagctccaggagtgttcctttctgttcatcctgctgtcctgtgtgcctgtgtgctgtcctgtgtgacagtacctggcacttgttaggcacctaataaaagtatgaatgagtgaagtcagaaagggaatttagaattaggaaataggtcattccagaccaagagaaacctagacagataaccagatgctcacttaggggaggtgagcctttggagatgatgtggaatgcagctgcaggcagcaggagcaagtcttatctaatcaagcagtgcattatcctgggagaatgttcagaagaggcaaacgagtgatagtctgagtcaaggatgacccacttcaggttctggtaggagacagaacagagtgtctaggacatgatggggtaagtatgctaaaatcctgtgtgtttatgacacacaggtgtgggtcataaacaggtctggcagcaggtagtaaggcactggattctaagctggagattctgggtcagggttcccagaaactcctagaaagacagtaacagtaatccttaggaagtgggaatcatttagaacaagccaaccttactggaagaatatttgattttatggatgtcttggtgtccccatagcagatgaaaagttgtaagctcttggacccacactgccttggtttgatctctgctcctataattcctgactgtatgaccttcggcaagttacttgccctttctgtgtcttcaactgtaaaatggagccaacatcccctatcacacgcattttctgtaaggactaagagttaagaaatataaagctcttaggatgataaataataaatattaattattgtcttagtctgttctgtgttgctacaacagaataccacagaatgggtaatttattaaagaaagagatttatttcttatggttctggaggctaggcagttcaagatcgaggggcctcatctggtgagggccttcttgctgtgtcataacatggcagaagacatcacatggcaaaagaccaagaatgggccaaacttgcttttatagtaaacccgctcttgtgataacaaacccactctcatgataacaacattaatccattcatgagagcagagctctcatgattaatcacctgttagaggtctcacctctcaacactgttgcattggggttaagttttcaacagaggatctttggaggacactttcaaaccctagcaattattggagctaaaatatgaatgctttctccaattccaaaatggacaaggcttacctagatatattagttaaggtaggccaactgctgtatcaaatagatactcagatatataatggttccaacacaaatagaagctcatttctaggtcatctaacagtatgagtaggtgaattcactggaggagtagtcctctgctacaccatcattcaggctcatggagctctacccttttccttgtgtggggtccttccttggtcatgctaggcatctatctatgtcccaaccagctaaaaggagaaactggcatgaaggaatgtgtgtgggatgttgttaatagacctggcctgaaagtggggactaatcactttctttcatggcaagaacccagttatatgaccttcctatttaaaaaggtggctgagaaatggaacatagctgtgtcccacatagaagagaaaaaacatgaattgtacttcatagctggcaatctctgccagagttaaggatgaagaaaaactacattgtttttccacattccatcccagcaggaaatcatcccatatccactgatttatcaggaaagataggccaagccattcttactttgtattgctactctgaatgtggagagagttattttgcaagatccccttttctattctccttgcaaactcttggtgtcccatgcttttgtaagcaatggaagagcttggtcccacctgccatcttggtgctttgattcatcctccaggaaagcagaagagtaaattcaagaaactacatcctatgaattgggtggaggaaagaaacaatgttccaaatcaaagggaatgtaagttaatagataagaaaacacatctagaagaaaaacagggaagaaatacaaattagagcaacttctattccaaatccatggtagtaaaggaggaatccagaatatgtcgaaattctaactgaagccgtccagtattttctaaagaagggttacatccttgactaaaagcctgtattgttttccatcagcaggtcaaaggatgggcttcagaaactctaagacttcctaaaattatatgagtaatattgagtggggtgttgtatttcattttttgttttttgaaggttcagggcttttaagaggatcctaaagatatttatggcccattgactttactgaaatgaatttcccagcatgtcagtcctgagagaacaagacagagatccagggactgtaacaatatgagagctctggagggcagccccctcattagtttaatgggaggacctgaggtgcagcaaagctgaggctttatcagatgctctctaaggtgccttccagttttatgatcaacaagaacattgactgattactcagtcaccagagctgagagcctgaggctcctctaagtctttttgaccagtgagttcttgccttcaagtcgggagaaactctcagatgaaagtcaagtggttggcagtgtactgaagagagccagtggtctgtgagataacttggttttaggtaattttaaaggtaaaaacaaaagctaatgatggtaatttgaggcaattgacttttaggatcacagggttccaccatgctttctgctcttcgttggaactttgggaatctcatttaataagtggtacctctcttctctgcccagatgatgtgtttgagcccactgaggctgagaagccaggcagatgaagattataaagtacacttgaataatgatagaattcttactgatggtgatttcagtgtgcagcaacaatagttttttttttttttaataccaagtcccctaatctttatagcaagattaggcattccagctcagtcatagcagcctggaaatattgcagactttgctctgcagaggcagaagttttgctgctcattgctcctctttgtagggagaagatactcatcagaaaagggaaggggttgtggccccatgcgcagtccccaaaatcagacaagctttttctcccaagaggtgagattaagactggagagctctctgcattagacctgttactccaataaggtgtccctgtagttggaagcctgaaacagtgcaaagaggaaggggtccatcacaagtctattcatgtccacataggcaagcagttgccagctacactcagaatcatatagttccttcctctgagaccaggagtagggaggcttgacccctagcttaactggtgataaaggattagcagctaggcatactggttcttgagggatgctgaccctgtttggagagggcttatccagatttgtccctttggttttagccattaggtactcctaagtagacccaggcaccaatgaagaagtgatgctggctgtcaggagatgaggttcttgtactggttgtccagtgaccagactctgtttattgtgtttgattcttcctttgctgtttttgaaatatcgtaatcattctttaaccatcgtcctatttatatagaggagaacaatggaggagcgttgtattccattcccgaggaagtggttttcccaaatttttataataaaattttatttgagagtaattttagatgtacagaaaagttgcaaaaatagtgtagagaattcccatatatccttcactcagtttttcctcctgttggcatcgtatggaaccagggtaccttggcaaaaaataagaaattaacagtgacacaaattattaactaaactacagactttgtttggattttaccagcttttccactaatgcacattttactgtctcaggattcactctgcgataccaaaccagtcttacttaagggcagtggaactaccgtggtcaaagcaggggtgaggggatggatcccccattgcccacagtctctcctttgataccctatgccctcgatgcacccttaggagcctccaggattccatggttcaattttctgcaacagagataggtgggctataagaccccctcctgcaaaaccagtcccagaggtgctgagaaaccctattttgtgagcaaattataactccagattcttacaagaatcttttagaactgtgcagtctggggcagccatcttcatatagcaagtggacagggctggagttactgttctctgctggagtttaggagtctagaggaaggtatgggatcttcttaaattcccagccctaaaccatgcgtttgttctcttcttcagctttgggagagggtgctttgtgctaatcaggagacgtggccacagactggagagacttccaagtggggctcagagctttagttacctgagcatctgctgtaggactgggtgtcgtgatatgcacatctcaggtgaattttgaaaaacaacttaaatgctaagacctattaagttgtacagagctgctgagggaatgaacacagaaggaggtgtgtgggatacatttatgctaattataagtattacaaccttatttccttgattaaagccagtggatctgcacactaattatctacaaaatatcagtcactttggaatacaaaagtctgttgagggacagggctgagatttaggacatcttggtctcagtgtcagttctgtgtccaggttccaaatcagagatttcactttcatctctaaaatctggagtttggattccagccatatgatctctttggggttttgccttctgttgaactaagttctgtgtgtaataataagtgagaagaagacttgatttttttaggataggagggggacatggccaaaggtagaataataacgtcaaagttgtcttaaccagtctgtactgttgctttgaccctagaccatagctcttccacatctcagccccgttttttccttcctgataaaataaaaaaacaaactccagttttgaagcagactcttctacattacctggatctagtttagtgactgaagtttaatttctgctccaccctcttcttcttctttgagatattgaggataattgtccaagattcaccctggtgggtagaagaattacctgaacagaatttctttgtatttttccaaggatgaggattatctaattattgctatcatctttgcactcctatacctccaccctttctagagcattttatactttatttcaatatggtggtaatgttggggacatctacctgcaactcaggtattctgaaaagtatagaactgaatacagaaaagaatctggtattttccaccctgggacactccggcaatctggagagaagatgacgtggagagggcatgatgaccaggaggttgaggtgcaaagaaccgggctctaacaatgaagtgatgaagttattttgtgaattctccctgcagtggcctgaggatattagtcctgggaagtgccctcccatttttgtttttgggctcttggcagccagtgacaaatgtgggaactagaatgcaggagtagaagccaagaagcctagattcagtctctctgccatgactcctgacatggaacagatccctttcttgcccaggacctgagtttctcatttgtaaagtggacatttctcatctttcttctacactgtgtgaggcttttcatcttttcacaagtactggccacaccaatagcattattgtctgccactgcatggaaactaggttgagagtttgtgggatgtactcaagtttcctttttagatacatccatggctttactgctttttttcctggactgggactgaaagaactgagtcccagttcagtcactcggtttctttgatgacattgtctttagatcagtgttcttaacctcaactctagttaacacttccctctcatgaggttaaattagatgcttagtttccaaacacatttgcacatttgctaaccctgtccatgttggtttatttcctaccctcataccacattccctagccattcgcaagatccatgtgtgagggatgggattcaattcaattccttgtccatgtgctaagatgaatagaacacaaggaaataaaaatctcatagggaatataagaacagataaaaatgtgttgctctatcataagccaaagggaggcaaattgtataaaaggcagttaagaatgtctaaagcttatctaagtagaggaatggcatgggtcttgaggggttggttggcagtctggattaaattttaggaagatatctccatcagagaggttagcatgagcaaagtcatggaggaagcttggaggtaaggaaaccagaagaatgatctagaacggtgtgtgattcaactggccgaaactaaggatctatggaagatgcatggaaagaaatgttggtaaaggaaagaccaccatggcagcttttgaaaggccaactattttggcttaggtagtcaatggacagtcacagaggatttgtcatctgttgaggtgtgaatcaggtcatgtgtaaggacaattcataaggcagtggcatgtgggatagattgctggaaactaagaccataaaggcaggccattgcactggcccaggaaagaggcagtgagatcctgtgccacagtggtagccatagagtatggaagagaagccattagaatccatgggctcaggactacgaactggagactggctggtcccacaggctcaaagccacttgcagtttgtaaggggcaactatgaaaacaaacaaacaaatacaaaacaaaaaaaaaacacaaaaaaacagtgaaatggagggtcaggatgtgtcttcatccattttgaggtgctataaaaaacacttgtggctatgtaatttataaagaaaagagatttgattggctcatatctctgaagactgtgcaagaagcatggtgccagcatctgcttctggtaaggacctcaggaagcttccaatcatggcaaaggaggagcaggagtgtcacatggtgagggagggagcaagagagagaggaaggagtggtgccagactctttaatgactagatctcatgggaactaagatgaataactcacttactacctggagaatggcaccaggccattccctcagggatccacccccatgattcaaacgcctctcaccaggccccacctccaacactggggatcagatttccacatgagatttggaggtgacaaatacctaaataaaccaggatggatttttaaattgcatcttttaggccaccaagtccattctgcatccttaaagtgttagaaacaacggagcagatgccaaatcattcaattttaaagaaatatatagctggaaggagccttaaatgtcatctatttcacccttgagggaccaggcagaatagcatcaaaatcatcccagacagatggtttgctcactctattccagtgcatcttctgggattccacaggtttccttccttattcctttcagctgtgggagagggaagctattttcagtgagagatttgtctttttctttctaattattaacattctttagaagtgggaagttctcagttgtgtctagcgagaatcctacctgctacaaggtaagtatgtttcatcctatgtccttagtggagataaatgtggtttatgttataaaacagacattataagactcagaaaaactaagaagaacctcaatgtgaccaaaatggccctgtggccaggtgcggtggtttgtatctgtaatcccagcactttgggtggcccaggcggggggatcacttgaggttaggagctcgagaccagcttggccaacatggcaaaaccttgtctctactgaaaatatgaaaaattagctgggcatggtggtgcatacctgtagtcccacatgcttggggaggctgaggcaggagaatcacttgaacccagaaggcagaggttgcagtgagccgagatcacaccaccgcactccaccctgagtgatagagtgagactctgtctaaaaaaaaaaaaagccttgtgcttttcataggtaattggttatattttatgcattgtttgtatcttgactggtgggaaaccagtggaataaaaatatttagccccctaatcctgccaaaaaataataacctatttctgagggtggtttctagttatctcctaaacttagtctcttctctctgcagtttagaaatccagttgttttcttctctcattgaaggttgtgcaggcatgaggactgatactggggaaaaaagacggggaagatgccccataagaaaattctgagacgttgaagcatgcttatattggattctgtcctcgggaaaggagaggaaaaggctgaaggagaccattgaatctggtgttgagtcattcacgtctctctactcctgtggagggcccttacggatgtgtcataacaggatctccttttccttcctcaagtgcaaaaggccttttttttttttttcctgagacaaactgaatatataacataaaaagatacataaatttccatacagatatcttctttactagctgtaattaagatatttgcaagtaaagagaatgttgtgttcccttgacttcctcctggtagggaattgtatttctctcataatcctcatagcccaagattttgtgatctgtcagtgtctaaacggaaggaggaggaggaggaggaatcagaagactgggtcaatacaaagcatctgaaattcagaacttcaaacacagtttttactctcggttgtttttttctaggctttgctaatcccaaagagcaaagttggaggtaggaaagttgatagcccaagagcagatgggccgagcacccactgacattgcagtcaggcagatattcaattgaatcactgagcttctgctgagagctatttggccttaggaaatttacttaaattcactaagacttagattcctcatctgaaaaaaaaacaatttcttcttttgtgcacattaaataagataagtattcaaattgccagtacccattaggcacccaatagatggctattattctatgtaaaagaataaggtagaaattatatatcagaaattttaaaccattttaagttacaagccaaggttttccctatgatggatctttattgctggatactaaatttagagaggagaagaacctactcaagagaatttagggaaatttaaaataaaaaaagccacccactcctccaggactggtttagacatttgagttgatctgttggaagcccaggaggaaagagaaaacacttttaggcatctgcaggaagagcttttctattgtggagttagtagctacaaccaggagctaatttttgtaactgtggaccatgaattctgcagtagacaaaggtcttcagaattaaaacctccttctccagatgtccttagtgtgtgctgtccctcatcatcccagagggagagcttagggtgatgcacctgtcctggagccttggggatagagaaaagactggcttaagtccagctctacctcctttctcctttcattggctatatgatggttactgcttattattatgcatagcatgaaatatgcaagtgtatatgcatatgcataatggatgtgcaagttctttgtaaactgttggtttgagtgctggtggttttgtcaccaccaccaccaccatcaccacccccatcaccagcatcatcaccaacaccatcaccaccaccaccatcaccatcatcaccatcaccaacgccaccatcaccaacatcattaccaacaccaccaacaccatcaccaacaccatagccaccgctgttatcaccattatagtctgtgcttagtaaataaccatgtacaccctggaaaaataaattgaatccatcaatgttccaaagttgactggtaggtggtggtctgtactccagctctccaactctgccaatcatcacgacaatcttggttgccttcctccattgagtcatgctttccagcctcttcagccagcttggaactttgatttgcagcccggtttgttcttgtagttggtcatttccttacccagtgggtcaatccccaacttcctgatctttgtatttattttttcacatcctgagacacttgggtacatgtttgttccatacctcaataaagcataagttcccttgaaggcaaaggagctcacccacgtttagcacagtgatttctacattaaaaatgcttaataaaagttacttaattaaaaaatacataatactatattagatgtttgtaatgggaaaagagtaatgtccccacttgcctaaatcttcttacatgaatcctcattggttcccactcactgggcaccagtggtcagtatgtggggactctgagtatgcgtatttgaaagatgcactggtatcaccaagggaaagccagctggatctgattccctgccaatggccctgacatctgacatctgcttatcagtgcagaggactggagaaggtctcacaataattaaaatacccataagaatggagttagcaccaaaaggaaatttattattgcacacagagaatcacattattcaaaggccatagcatcaaagcatttgttctcagtgagctagtccatgtgggaagctggatcataatgtgaaagttgcttaaagaggaagaaatcagggcaaggatgttagaagagtcaaataatcaacgacatccagctaagaaagcctaacaacagggttcctggcttctcagcaggttcagaaatactccatgtcttttgcctaaatcctcctctctcccttgtccagagccaggaagggatgaacatctccaccatccagttccaaggctcattctttcccaggcctccaggatcagccagtgccccatctgagagatacattatttcttcatctgtatcaatcagggcacaatgcagccatgatagcctaagagccactcaagatttttcagacaaccttggatatacatccatgttttcattcattttctgctgatcgtaaagaggccaattgtattttcttcattttcaaatgtttgggagccactttattacagcccctaatgcttcccatgtcactgaattgctttcacacctaaaaatgagtccttttgttgcttgcaaatcttattgccttgatacctagtattacatgccccagggagggtacatattaatagatttcaagtgcctgttctgattgactggtgattgcccagagtggagtgatgagaagaatttggtggttgcatctaggatcagtgaaaaagtggtgatcagctggtgacatctgccatgaaagtagaaaagaggattggtggcacttgtgtcctgttctgacacatgtcatcctgagcagtgctctcaattcagggattctgctggaccctgttaggcatgctctaaccttggattcacacaagtggagggattctaatgtgacatagatattgagtttattgagtgcacctgtgttgaaggatcatattcagagaaaggggtttgccaggcggatctgctttactggggctaatttccccatcacataaatgagactagcatccccaaattctgaattctcttctactggcctttccctcacatttcaactaaatagttggattttttcttcttttcttacaacttgtatatagcaaaagtgccttgtttctgggtagatttgattcccctttacacactgccaaggtgtttagtagtctagatacagctttccctgccagctctatgccatcatctctgagccaacttttatcaatgtagcagcaggatcttgaagcatatatatatatatatatatatatatatatatatatatatatttttttttactttttgaaaagttgaacagcccaagatcagggtttgccgctagagttctgctcccaagcagacattgattcaattatcaacattctctggatatggtctatgcatttttattactccacccaactgttttgtaagtattctatgagagaccttgataaacgtctggatgaaatttgggtaagcatctacactggcaatcttgtgaaatcctgactagaaatgaagttggaggtcatctttcaaacccacttatttgacaggtgaatacattgaatgccagccagagagagagagagagagcagatgtccctcaagatcacacacctagttagtggtagagtgaagacaaggacattcttctcccttcctgtgaattcagtgctcctctctaaccaccatcaaagtgctatgaggtcaatgggctggcatgattctccctatttacagacaagtaaattaaagctcagagagattagtgatcaatccccagactgtacaataaatgaggggtggaattgggtttggtgttctggttaagttaggtttttcaagggatgagagtttacttgtgaatagaatgtttaaagagcacaccaatacagcacagtctccatgaggttaagtagaagtgtgagcttgtaataattgagttccatgatctatttttctaataaggctttgtggcaaggccattcaaggcaaaggaggaaaacaggatgacccaagcctagtcaacgcagcaagcaaagatgatttaatttagagattttcggctctccaatgtaatcttaaagcaaccagcagcaacgtgatttgaggtgattgtagtctgtaaaatgtaacacagattcagtgaaactgaagggcgaggaaggaatattagaagcaagggaggtggtgctcagagttgaggagtattgtcctattgccttgaaatgtgttgcaagaagtaattgttttaatgtttattgtgaaaatgtattctcaagaactttgattgacacataatcattcacagtagcttagaagttctttaagggcagtattcatgccttatttcactgattatataacccttgtacctaggactatacatgatatatggtagacatttcataaatgttcattaaatgacataaaccaggagacaggtgttcttctcagcgaatgactgatctgggatgatgcttaaggaccctaatttggaacaatcagagatcacaaagccaggtttcagtacagagatgtatgcaagggttgtcctccattattttggtgcaatgagtgggctctgcaatgtgttcctcacccacaggggtggcaagattggaaaacgctagagatagttgacacctgagggtggtgaagcacagtgctgcaggaagttacccttattgtgtgaaaatggaacagaccgtcctacaagatagtgggttctccatccccattgggtttctagaaaatccttagaaccacattatacagatgcctgtgctggacatgaggtttcagaagatgatctcaaagttttgcttttctctaattctgagatcctaaaagccaactctacaacagagattgcttagataagtgcaaagtggtagagcaatttaaggactcataattatgtacgtgcaaggaactgtgtcaagtatatattttcatgatgctatcaaatattaagccaaattcaccctctgcatatctacacattcacagcctgaatcctttcccacttcgctcatacctcaatacctgtcacttgccctgtctcttgtctctccctgtgactgtgtttatcttgctctgaaggctttcttgaggcatttctccctcctttcaactctaaaaatccacaatctatcctacattaaagaaaaatcttcatttgacctttctatcccttctaactttgcctgaatattgaaataagtacttttcatcttctgtcttaattttttgggcttctgatcttaccactgaattgaatctgcagttttggggtcactaattatctctcacgaccaaatttaaatttcttacttcaagtctaacccttcctgaactattgttgaatgacattattaataatttaccctttcccctgcaccccctgcaactgccagtgatgcatagtattcttgttgaatgcctcagttatgctttgttccacaagttataaccattcctggtcattctttccctgctccattggtttctctccttcctctcattttaagtttgggtgctgctattttagacatctgctttgcaaacctcatgcactcacatggttataacccctttttacttttacacagaatctgtttgaaatttacatttgcagcctccacttcttctctctttgattgcttaatctgtaagcctcccctggagagttcactggagactgaaacacggcatgttttaaataaaactcaccatggcctcctcctgcttctctgagtgctagcacctcagcaaccgttagcatccgtgaaaactctcttgggagcttcccaaaggggagccatttctgaacctgtctctttatcaccagcctgctatgtctttccttatagcacctcagtgccactttttctttgcacgttggcaggagctgcccgggtccatgcctggtcagtccaaaacctgaatccacgcacacaccttcaggcttggagctcttcccccagggctcctcgaacttcctcatccctcctgtgtttttggagccttgtgtgagtaaatcttcatttcaccaaaatataaatttcttgccctggcctactgggtcctgaagcccctgccagtctccttcctgaccttccacaagaagcccccttggctccatcccagccagtctgtccccggtggcccagcgccagttgcttatttccacctttgcatgaggccctctgtgttcatttgttcgggctgccatagcagtgctccacagactgggggcttcaacaacagaatctgattttctcactgctctggaggctggaagttcaagaccaaggtgccaacagggttcattcattcagaggcctcgctctttgtcttgcacatggctgcctgctcactgtgtccccacatggtcatccgtctgtgtggtttgtgtcctaatctcttcttataaggaccccagtcctattggattagggcccaccctacagaccccattgaaccttagttacctcatttaaggctctctctccaaatacagtcatattctgaagaacttggggttaggacttccccataatgagcatgtgttggggggcacacagttcagtccatcacaccttctcttcccaactgcccatctgtcctttctttcatctccgtcttctttctttctgttcgtccctccctgccatcagcactcagcaatccccatttcattgtcttcactggatggtcttttcagcctcaccctatgagtttgtgcacagggacatgttacttcatgaatctgcctctcctccaggtcattccagtgctgcttctctgcctctgactcaattgagagcagagactgtgtctcttgtctcttgcacacagcccttgacttggaagcacttgagaaatgccattgctaagttactgtgagtccctcctcatgcacccccctcctctcacttctcaggagccctttcaagggaaaggccttgcttaggagcttttttcctgagtggtgagggggaacacaaatgttaactccatggacagcaaggaggaggagggctgaggctccatggtggtgacattcagtgagttaacctttctaaatcaggaaggaaaggagagggaatctgggtagccctaaaagcagtggtgaattcagggattttctgcgggacacactaagagcaataattctctcagaagctttggagaaagcgctgtttctttgacctaaggggctgaaaattctagatagaacccacttcctctccaagcagtaggttggctgggaggctcctgctgggagtagaaccaagctcgtggagggaagcccattgcgtcttcatgtcccacagaggaagacagctgggtgtcatgtgctgggagtggtgtcatgatgtgctggtggagccccgagtgccttgtgtttctgggcggactccagagtaagggccttgaaggtgggttgctgcggtcttccgctgtcctccctaatgatgcaggacaaatgtttgaggccctgcccaggagagacacgccattcagttaaagatccccctgctttcctcatgctcctcctttcatccttccatgcttccttcctctcccttcatcccttttcttctctctcccccttcccactctctcccctcattcactgtcaggaagggccatgccagaagggcccgttcagtgtggtgtggcagcggcagaggctagcagcaacggcagcttccacagtgagtctggatttgatttctggggccagggggctgggcagggcagtccacacacagacagacagcttgcaggctttggagaggcacttccatgggctggggcctgcttccaacctctttttccttgcctcccaccgtggagcatcatttaacttccatggaagtttcctgccaaagccattgatgtgcttgggatgtctcatggggagacagcatggtggggggtggcgggccataatctgctaaaattaggtgcacagccgggagagccgctggagttcacatggctgccagggcttctgtccagacctgtgcgtgtggtggaggctgaaggctctgcatggacgagtggtttggctgctttcttgcatttcaggaggtgtgaccttgagttttgagtacactttgggtgcttacactccataggagactccctgtaaggaaataagaatgccctaattgcacagagtagagggtctaagaactggaggtctccccattgacctcagatgaagcgtggtctaacagacctgatgctcaggatggtcactacagatcctctgtgactgagtcagatcccccagtgcttgcagggaggcttttgccctccccattttaatttctatggtaatttctggcagggagatggacatactgcagagtcagtcgaagttccatctgtcttaccttgatcatcagactgtattggatgacttccttccactttttgcttgggggcttttttcttctatttgggaaacagttcacttgggaaaacagaaccacagaattcacctactcagccttaaagatccatcccagactaagaagacacaagttctgcttgccatcttgagaggctttccacaggccagaggctgcttcctaacactgacagggcgtgcggtagttaagtcagttttgaagtgagaagcttctggtttctaatatacagtattatcctgatactgcagtcttatgggcaggtgcatgggaaggaaggcttttacagtttcattcatttctctcataatttggttagggaggtaaattaagcataacctcccaggttctctcaggatcagttttataggtttctcttcttgacactgctcctaataacagcatgaaagtttaagattttcagtactaacaagtgtgtatagctagggtatttcagaacaaacatgcttggcagccttatgagaattttgcaagcagaaccattatagaagattaatcaatctcttctcatgcttttaaaatattgtatgtatttcagtcgcatcgggttcaaactcttggttttaggaactgacaggttgcattaaaatatcaaattggtcaaatttattaattaatttcaacaaacatttaatattaatcaactgtgtatgtttgattgtctaaagttggacccttctgagaatgaaaagggaagttattaataattaaataggagctacaggcataaatttagacctttcttggtaaattggggcatacagtcattttatccatgtatcctgagttattgttggtgccagtgatacaactgtgagtaaaacagacaaaaatcgctgcccttactgagggagataaaaaaataaagataaagtaaagtatatagcaaattaagagtgataggttcttaagagagaaggaaagcagagaggagaaaaagaagtacttggtggtagtaatagtggtggtgttggtggtggtagttagtgttgtgtgtgtgtgtagtttaggtagggacgtcaaagcaatcgcattgcttaaagaatacgaaatattttagtttatttagtttctccaaggagggctttcatgactcagctaaaacttactgtatggatgaaatcgtatctgaaaattctgagtccaaataaagaaatactcacaaacttcataatgacagaaagcaaagagagaaaaccaggtggctgtggcactggaaggataccttgtctgcttgatggtcagcacgggtttcatctccctctgacaccactgagacggcatcagaaagtgaacatggctgtggattcatctatttggggagcatctttgtagaaagtcccttaatctctgacttgtgctggccattcagagcatcttaaggcccttccttctcccatctgcctttctgtggggtaacggaagggcagcttacagctgctgaacacctgctctagccaggcaccttgataggggctttgagtaaattaatttgtttaatttattctgttctcatgaagacattattatagttccactttgaggatgagaacactgatgtttaagctcagaaatagaaaatagtggagccaggatttaaatccaggttgaattatgtctgaaattctgcctttatcagttagcctcagcatctttccacagataccagttggcaggaagtggaagtaagaaaaggactcactgggtgacccgaatgtcccatgtgtgggctgatttgcatggctggatcaggagcagtagatgtgttggggtggttgtccatgtctttgctgattgcgcatgaaggcacagcaacttctgctgctttgttttttgagtgttgtcactggaaatggggatgggcatgggaaattttgggggcatgagagtaaatcttcctgtgtggcttccatcctcggctgaggtggaggcttaacttcagtgagtcagtgttcctggggctcacgcacgttggaaggagggaccatgcatggtgtctatgtatagataatagaggtggggagaatgcatgcagagtgctgagactgaacaaaggtttttcgacaggggtttgagcgaagagttgagtttgaagataatcctaaatttcctgtctgtcttttgtgaatggaatccacagactgacctcatccagtcttaggatgctattagcaagaaacaggatgtctctggaccacatctcagatatgatggttatatttaacctaaatatcactgtgtaatgttgcatttatttgtggtatactttcatatatttcccagaaaacaaataggtaacctgttgttttacgcataatatggtaacctcctgataaggttatgtttcaagcaaatcaccatttagatgcggaagagagacctgctacaacaaagtaaagaattactttgggatgccaataaccctctccagttttctttttgtgataaagtagaagattttctacctgtgatgctatactttccttggagttttagagcatatttatcccagggtctctatgcatgtcaagacaatgtttcttagtttcacaacatgtgtcataggggtagagagaagccatactcttgtcatttggcaaggattttctttttcattacattgttaccatcacagaaatatactccaagcactgggatgtccctcgctgtggtcttctaactattgggtagggttacctcatcaagttttggttctttactgcttttagggacccttgtctagtttcccccgtcattttgatacttgagggctgaggaggaaagcatcattcatcttcctccataggatactccactttcacttatctgagttctccctctggtagaaacaaataagcaagcaaattagcttttcttctaaaatattaacgcatctcaacacagttggcttctctcttctgcatatgtgtgctctgtggagtcccagctgggaatcagggtaaagatgagaagtgtctggttatatttcaaactgacaaggatagtcattctttttctggttacatatgggccgccctgccactcacacatacaagatatgtcttaattccagaagggcttagctgaagcttaaaagaataatacccatgccttagacacaagtctgcaagggcacctggtcatgagtgtgcctcggtctgggaatctgcttagagacttggtcatagatgcatcctttacagcagtacgccgggatttcaggggtgagatgaacctaagaaaaaagattcagagagatcccaaaggcccatattaaaaggcttattgtggctgggcgtggtggctcacgcctgtaatcccagcactttgggaggccgaggcggatggatcatgaggtcaggagatcaagaccatcttgtccaacatggtgaaaccccgtctctactaaaataaaataaaaaaaaaattagccgggcgtggtggcatgtgcctgtaatcccagctacttgggaggctgaggcaggagaagcacttgaaccccggaaactgaggttgcagcgagctgagattgcgccactgcactccagcctggcaacagggcaagactccgtctcaaaaaaaaaaaaaaaatgcttattgtagtttcattctagcagggcatgtcttggtcatagacaggtcctttaaagtagcatgctgggatatctccccacccaaacaaacttagtatttctaaggaacctaaggacacacacctgtttatttccatgtccagggtacacaaggagagcataagacaagctttgttcacccctcttggcatgcgagtgttttccagccatcactgaggttgtggagagggtctggttgcagtgaagatgtctataagctagagattattctaaaacccactaggactttcccaaagtcaaacaccaatgtagtttaatggttttgaaattgtggaatgtggtttccccccttttcattgctatcccaagtcttgtgatccaagatcattaagactggccttctggggaaaaccaatacagtcccctgtgtaagatgcctgtgaatgtacagggtatcgcatgtcctcattagtttagggagtttggttgtctgttcttagtcccagtcctctgagttcttaactggagatttatccagagataagaaatctgcccattaaatagtaattaatctttgaactctcagttgccttagcattttgctttctgatgatctgaagaaatatagtgtctcagagcagagcaagcccctagaacaggatgataaaaggggcctggaatgcagtggggctcaggtcttcaagggaaggggttgtaggagctacagggaagatgatggaggaggggagggaatctttctggttgtgccatccaggaccactcactgagaatgttgccctagtctcgtgatgggacttcttggtctgcatcttatcttcaaagctggtcaagtccctttgcttccgcaattcttttgggacaaatgactcatgagaaattcatatgactacaagaattgtgacaccgcctcctgtctggcgatgatgtgggttctgctatttctagactggtgcccacctctcttgagccttagctggttcctctgattagtgctgcctcctctcttcctgccacttgtggctagccctaatggaaagtagatctccaggcagatgcatccggctgaagaatcctggcaccggggcaaatgcagccctccaaggaaagcttttagttcagacaccggtctcagagcccacaatgtgaactgtgtcctgtgaggctttatggccagtgaagctctggcatttgggtgcagacatgtagggtggggaaggagcaagggggagtcggggtgagaggaggcttatcgtagtttcatcctagctgggcatgtcggtttttacatgggcctctgggatctctctgaatcttttttctttggttcatttctagaaatagacattgtatttctagaaatagaaactaacttgagagtcgaattttctagtgttttctcaggattttttcagctgtgacagaaaactctctaccttaagcaaaaaggcaatgtactgtctttataataaaatttttgttttccaggtttaggaattatttctagtgttggcttcattctaagacctaaataatgtcaccatgtagagcctgttgcttcctctctcccttcttccttctcatctctactctgacttctttccataatttcatcatcattctctgcctctctctttgtctgcccaagaccatgatcttagagaaagagatgttaacgggaaatagatttccaaacaatcaaggctaatgtattttgaaaattatgatgacaaatgctgccacagttgaacacattatctgggacctagatgttcagtagtgaaggcttgtcctcgtcagggaggccttgccatcaggagcctagctgatgaggtgagaaattatcagtgccatttctacaagagtgggacgggacattatgcagagaaaagctccaagagaaagacacaggaagcaaagtccatgactggcttcttttttccaatctgtctatggaggaacatagatattttctgatgtcatctttatgagtgctctctgggctggtgtaggttcccatcttacttcattgaatctgctgatttagatatttctgaatgaaaattccccttcagcttttctgagtgttttatataaatcacatttataggatttctatcacattgtccaaaatgtgccaccctaacctatcaatttacatgccttaaaacatttttactaatgagtctttttttaatttagaatgtataagaactttaacttggtggtgaataagaactttggttttggaatcagaataatttgggtacaagacttggatttttctatctcaagcatttttgaataagatgcttaacctcttcctctcctttttcccttcctctctccctttctccctctctccccccctccccaactttcctccttcctttcttcctttctcaatacaatgctgtcgataatagtagttttcatagccaatgcgttttaggaggattgagcgaagcagtgcattttaattcatttagcatatatcctagcacagtataaacatgcaataagttgttctatatccatgttcactgggacaagaacttagcccaactcaactcccaaacttggaatgctgaaagcatctctttctacctctgttatggtggaggccagagcttcagataaattaagatgagggctctacccttggggattacctaccccagcactcagcctggcttgaccttttggggacccactaggtgaccctgagaaagatacttcatcccagtttcgttagcctacaaacaagaagtccacctgctcaaattccccttctatattttttggaaacaggaatgtgtgttaacagaggaggaatgcctttgaataacaactctccaactgtgatttctggcttcacatttaagactttcttgtaggttcatcctcagagcagtcctctcctgccttttgaccttgaaggagaagccaagaggcagggcttgtttataaagagagatggagcagcccacagctgcaggcctcagattatggcctggaatcccagatgctgcatggaggtacagctcctccatctctttcatctgaacctgcccttggcctacacccttcactgccaagaggcaccccaggacccagttgtagagtagcaggctgtgtggaacgaagtggacctcagagctctaaccttctcacagggccaggaggggcatccaaagattatccagtctctacttgaccaaatcatccccttttggaactggatgatccctaaaggtcaactagtcgaagtctttccctcaccctaccaattatgcagatgagaacacagaaggccaggggtgagccaggaggtatgatgcaaactaaggcagggccgtggagctcctgaattctggcccatgctctccttcactgcctacagcacacacacacacacacacacacacacacacacacacacaccctctgtaaagtcaggctgctgatgctgcaggtgttaggaagggccttgagttgagctttcgttcagtgttcttgatgtcctgattcagatgagaaaattatgctcatgcaatttttgagcagagaggaatcttagcaaaactctggtccaactatgtcattattccaagtatgaacattgagaccaaaagaaaacatgggctgccaagaccacaggatggcacactagtagaactgggacaagaacccagatgacctgagtctgaatccagtgctcttttcactaaggttcctggtttatcttggtgccagaccttccctctgcctgtccccattccaggatgctaaagatgcctctaggccttgccagggctgtgtggctgggttaatagatgcccctttcctggcatttcccagggaaaggcccaactagaaacctatggtgcttaaaaagagtggtggtacttctttttttgatgaatcaccttgcagttcccagagtgctttgactgctgttaccacccaacctcagacttccttgagaatttaacgctgttattttttccaagttgaatccccacttttaaatgaagataaaggactttatcaactgtttcatgtctgtggtcctgcaagtgatctatgagctctctcctctcagcagcaagcatccttcctttagaattaaagggtcttttttcatgactcaaagacaaatcccattttccattggatgaagagtacattcaactcccaagaaagctttaggtgtgtgagaaggctaattgtttccaccttctccttgcccttatcaaagctcctccagcagccagtcagtgaacagatgggaaattcagctccagctcagagaagctagataaggcagcctgtagcctgcgaaggacttgtatattctttatgtcctctcccatgatgtgcatccgactaccctttgcctggggatgtggccatcagtagtaggtttctgctgtgctatgtattgtttactgaagaaattaaaatatgcaaagtgttcctggtccccctttttgggctccctctccagctccttctggcattttctgttggcagttaataaaacaaaaggggggcccaaaggctcgggtctccctccagctagaatggttaatttggagtggtttggaagtagtagatattacctctagctacagttgtgcctttctggctgatctgtccaacctgcaatgtgtgtcctgactgatggagttcgaatgcttcatgaaaggggcaggggattaagggcacagaaattgagggggtgggggaaggagaaaggaggggtgggtctccttttgcttattatagcagcacaaaccagcaaagacttatctttcctcaagacagccttacgttgaaagagctacagtccaagacacttgaaaattactccctaatccagcctaaatctttaccatcccttaccactaattatgcccatctacctgcactcatagaagttccaaatccaatcccttaccttatttaaatcctggacccagagaatacctcttgcaaatatttataagatatttatacaacactactgacaccattacaactcttattcatcccaatgactgggctggcacttggtaagccccaagatatgttagtaagtaacagttgcaattagagttgttatggtgttagtagtattgttcgcttataaatatttgcaagaagcgtgctctgggtccaggatttaaataagatgagggactggattgaaaatgtctatgtgtgtcagcctcccaagtagctgggactacaggtgcgtgccaccacacctggctaatttttgtattttttttttttttttttttttagtagagacagagtttcactgtgttggccaggctggtcttgaactccagacctcaggtgattcacctgccttggcctcctgaagtgctgggattacaggcgtgagccacagcacccagcctagaatccctgattcaaggatccaatgccatcatcttaaagctggtgggatattcaatcaataagagatattattaatgtcgcttaaaggatgactcagtgagcccattcctagctaagtttgccttttgtggaaaaaagtaaaaagaagcttcacacacagaatatgcagtctctgagcctagtccaccgtagaaaactgcacattctaaccagcccacccttgtcttcaaaattcactttagctgctcctcctgagtgtctaagccccgcttttgtaaacagcctgaatccaaggatccagactggcagtcacacagatctggcagctcctttaaactgcttccagaacttaggtggaactgccttgaacctacaaaacccacaaaaagaaagacttggagtgcggcaatagattaacttctatctctggctttaccatgctgactggctggcatatcatccctgaagtggtttctcatccatacatttgggattattgtctcattgtaagggtaattgggcagaatgtctaagtccttagaaaaaataggaagtgctgtgtaacacacatgatcataatcattgagaaattagcatctttcaaggaagatttagattcaaagtattatgtatgtgcaggtgtcttgaagccttgccatgcctctgtttcacttactatctcatttaatttctgcacatgttctgagtgtgttattattcccatttttatgcacaaggaagtcaagtcttccagaggttaaataaattctctatggttgcttagctagcaaagagcattggctgagttatacattatttccttcgttcttttggatcctctatttccttatcctgtatacacaggatatgtatataattctgatatgttataatttttatattttttggcctctaactatttagtaaagtcaatcttatttgaaagaaattatcttattttggctaaataagtctgaatctaaactagaacctaactctcagtacctgagctatgcagggtcagatttttcaaaatctaggatcattaaaaggatgtattctaccattgtttacttacgaatatggtattataacctgcatttgggggctgagtggatccctttgaatctagtgtgatccatggatctgagcttggttgagacctccagctttgttgagtgacttgagctcttttaacatcatcttaaaatttgtttccactagaagatattagtgcagccaggaggcctcagtggagccatttgcaaaaggaaataagggccaaattatttttcaactcacatctttggagttgaaatgtctgctctattaaaaaatacattgcttgggggcagtaaaggacaatgaggtgtcagaaagagtgctagaatttaggcaggattaagaaagaggaaaacaaaataagttataaaaggcatgtgttcctggggcttccctcagaactttgctcctggcagatgcagctctaggtaagagaactggggagaatcacaatgggcctatttatcctctaggctcacactgctaaacggcttggctctcaactccttgtatttttggaagactccaagggtttttcctaatcctggggctagaggctcagactgagacagccgttccactgagattctgctaaatggatgctgtttgcgtaaactgtcagaaagccctgctctgagggagcaatactataatgatgtctttgtgagttttcgctgcattttccctccaaagaatctcaagcacctactagacccggggctgagatattcagtttgtctctaagaagctagataatagtctgtcctgctttactgggaagaggagaggcaaaaagaaggcaagcaattctgacttaataagtcagaagtctgatgtcactgtagaaaagtcataacctcttgtataaagctttcatctgtggggtttccataactggggcgaggccacagatggacatgtatctgtgagtgcacactcatgtattgtagatcagaaatcaaaaggatatccaaactaatatatccctaaggcatgcacccacacaaactggggagaacacagagttctaccaggtgactcaaagtctatatacaccaggataaaaagaaggaaaactatagaactgtcgatgaatggagtcaaactctgtaatatatatacatgtatatatttttttctttcctttctttcttttttttttttttctttgagacagaatctcaccctgtcaccaggctggagtgcagtggtgcgatcttggctcactgcaacctctgcctctcaggttcaagcaattctcctgcctcagcctcctgagtagttgggactacaggtgtgcgccaccacgcccagctaatttttgtatttttagtagagacagggtttcaccatattggccgggatgatctctatgtcttgacctcatgatttgcgtgcctcggcctcccaaagtgctgggattacaggcgtgagccactgcacctggcctgtaaaatattttaagagatttattctgagccaaatatgagtgaccatggccatggccagacacagccctcatgaggtcctgagaacatgtgcccaatgtggtcggggtacctcttggttttatatacttttagggaggcatgagacatcaatcaaatacatttaggaaatatatttgtttggttcagaaaggcaggacaagtcaacgtggggaggtgagggtgggttccaggctataggtatatttaaacattttctggttgacaattggttgaatttatctgaagatctggatcaatgggaaggaatgttcaggttaagataaaggattgtgcacatgtaccctaaaacttaaagtataataaaaataaataaataaataaataaaataaaataaaatgaaaaaaaaaagataaaggattgtggagaccaagttgtattgtgcagaggaatctctcagaaagcagacttcagagagcgagcaggttgtaaaatgtttcttatcagacctaaaagggtgcctggctcttagctgattatctcccagatctggaaagagaggaaggaaaacaaagggggaaggagattctccatataatgtggatttttcccacgagagactttgcagggcaatttcaaggtatggcaaggaaatatattttggggtaaaacattttgatttttttccttgttatgccaaagtcagattggaaaataagtcatgatatacaaggttaaataaaacccatgtgatgagaatttgtggtttctagggcatactccccagaccccttagataggaatttgggcaagataaaaaattccgagcttcatcctcagaaccaaaatgtaaacttcattcagagactcaatctgtatatttctgatttgtttgcctttgtgtatgtatgctatagtacagtagtacatttacattaaaaacaataaccagacactgtgggacttcagttctgtttcatttactattcttagtgacttggacaagtcattgcttttctggccaaggtttctatgtctacaagtaggctgggtaacttccaaccctgtgtgtttattagctacagctttagtgttgaatctttcctttcaagccctgggttctgagaaacttggatttgaggagctggacaaggtacagttacagggtagggctgctccccacccccacaaagatataccaggaatccagatgatatctggagagaaagtaggatgaaccaccaaagagatatgcctaataaatgatcaggtggctgagaagagagccaaagaactggttcaaaatacagtgtccagtatccacaactcagaatagtcttagacagtgaggagagagtagagcaggggaggaggaggaaaggtaggaactaggggagagtttctgaagaccaggctgctatttctaagattctggcagcctcttgcatatgtggggaaggaactattgagacataccaacagttggagaaggggggcagtgagaaaggttcattccaggaaggagggctatatcattctgattaactagtttaaaaccaaagcattctcttcactgcttggagacagaacacattagaggaagactttgggtctttcctcctccatttaggccatttatttctggaaatgtccaagggaagtttcaccaaccccataccatcagggaatgatcagggcaggaccgacaggcccaggtctgtatctatgactgtacacacgatgcacatgcattgtcacacacacatgtccatctaaaccacctccccacagtgtatggatgtgtgtatgtatattacatgtagctaacccattatgtgcagccatgcaagtgaattcccaaaccctctggaccaagagtgccgatgattttaaagactgttatggtggctgctgggactgctagtgggatcatgttcaaggtgactgctagccatagctgatgccgtcctcagacagccaagcaaggtggaacaggccaaggccactggggcgtgtgggaaaccagacttcccagggaatgacgaaggcatagatttagtttttcatgttttcttaatgcacataaccacttttctatgtgaatagacatggaatcaagaaagattaaattttaataaataaaaaaatggcacttaccataaatgacaccctttatgacaatctcctgatagaccatttatcattaacatatgttgccaaggttttaccactcttcagagttgtctcctccaaagtagatgagttgctttctcatgtacttcatgactcagcccatgcagattagggaatacagaggaagcttgaatccctccattggttccagaaatattatgccctgtgaatccacgcttgctcatctttgctgggtctcggtttctttatctggaatatgggttacttcgtgtcctgtatgcctcatcggagttgtgtgagtatagatgttttgaacctctcagtgagaagcaggcttctctgtgatttttggaatccaccagctggctccttctgtaattagatgcggaagcctgagaaccttgtagaacttagctgagtttctatttaacccaaagcggtgggttccctctaactgaagaaaagttgcagtcactcaatggaaatgagcaagacaattctcttttcaggaaaggctggcttagaagaggagggacagctgtggttgggtgagttgggaggtaggagattccccagagtggaacactgccatgcggggcattctgccccaagtagaacctggagcctgagaatttgtagccactagacttggaacaccttctgcaccacttatttctggccctgaggagtggggcaaagtgtgagccctaaggacttgaatgaaaaagatggggtttgggggtttcagctaggcatcccagggctggaggtggaactgctgctcttgctcccctcctgtcccattctcccagtatatagagctgatggcttgaggaggggtacgatacagccttggggaaagacaagaggagcaggactctgaactttgcaccattaaatgctcagtctctgtacctgtggtcttgaaatgtttatgctcctataagaatgttgaaaaaatatatatgtccgttgcacatcttaagttgccatcaaaaatcttcaaagtaattttgaatagttgcattcaatgtcatttccagaatattgtaaatattgacattaaaaatacatcattcctttaacacatctgatgaactttaagtaccagagcaatttggtacatcatctattaaacacatgaacaagttcttaaacagtcagttttacatggctcctgttccttgaatttatattttcattgcagttaccccactgaattttatctttatatatttttatgcatgaaatccttttattggccactctatcataatttactgtgacaaaaatatgtatgaagatttaaatttaacttttaatggccaatgatcatacatttctagatgttaagtgtttttggtttgagttatcattatgattactagtaatacacagaaattggaaattaaggtataattattagtgatgcacaaaaaagtcgtcgacaaaataatatacatatcaatttttgaggaatataaaagataaaatgtaaaatattaatggaaatgcatctcatattttcaattagttcatgtattcattaatgaatattgttttaaactaagaaagataaattgatggaaaagaaagacattttgttattgaaatgtaactcaattctttgaactattatctagttatactcctaaaatcacatattggactcttatcaaaaattactttcaatcttctctcagctgataattcttttaagtttgtccctctccagtcgtttgaaaataattgaaaactatccaacttgcaaacagatatttccccaatcattagagattcattttcaacacctgtaccagtattttatacagttccttccattgtactctgtagggtttcactcctgagatttagaatgggtgagaagtttgtccttccttttggagagtggtgtgtgcgtgcgtgtgtgtgtgtgtgtgtgtgtgtgtgtgttggggatgggggcaactggacaagggattgatggctcacaggggctctgcatttaattttagaaaaaatccatgtgagagttgtgcatctgcaaagtccctcaaaactatccttgcctgagtacacgctggatagacttcatgttctgcatattctggtttgaaacctcttgcatggacactgtactgtatctctgcctattacatggcacggaaattctagacctcatcccatgggacagtggctgttgctcttcagggtgtgtatggataacatgaggtatatataaaaagtgcacttccccatggacaataacaaaagactggaaacaatcaaagtgcctattaataggaggttagtgggagaaactgtggcatctttaagcacagtggaatcctctacagctataaaaagaatgagtgaacttcagtgaaaaaacccaagaacagaacagatatggtatgttacattttatctaagatagggatgaagtgaatgtaaatccatatttgcttatgtaagaaacaatggaaagataaactaaaaccaaacagaaatggttatctgtaggaggaagagaacagggtgaggagactgagcagagatgggacaaaattttgcttgaatgtaccttgttttgtggttttgactttgaaacagtgtctcagtttttacatcattataaagcaacattaaatcaaatgcaaaataaaaaacaaagcaagtcctaaaaattaaaagcaaacatgaaacaaataagcctaattgtgtattacactggtggcttcaccacacagaaaggagctactacaaatgactttaaaacatagctatgttttctacatgcccctagtaggtagattctaaggacagaaagagctgcaaagattgtaggttgaaggttgttttcagtaatcatattattagtaataatatttgaactgttattttgaaactctctctaatatactgtatattatttaaacaaattaggataaagcagataatattatgagtgttaataggaatcaagattttctgcatgagaaagaacacaaacataaaattaaagaagtaaaagctctgtaaatttgatatgagaaaaatcaataagaagtcatgatattttttctcttaagaaatttttttcctagctatttttataacaaagacctagaaataataaccaccccagtagagatgagcactccaacgatccatgttgtggtctttaaattccattgccctccaaaaggatccaggaatccctggagatatggctgattcaaaggctggagtgggaaatatacaagatgagcctagagtattattttatgtcagaaagcaaggatgctatgaagactatttattggcgttatgtgagaagacacaggcataggatttcatttcccaaagatgaaacaccaggcatcagaaataataactactaactacaatagaatgaaacacttcaagtgtgtgtgtgtgtgtgtgtgtgtgtgtgtgtgtgtgtaaagaacaagcattggtaatgctttccaaaaccaaaacaaacctctcattggtcacctctggaggatgctatgggatgaattcattattctaataactagcaaataaagagaatgaatttatcttaccggtcctgtataaacagtttccagtgtagccaaatagctgatgaaaggaactttttatttataaaagatttccagctaatatatgcagaaggaatactataattacaatgtctcccttttgcagccactaaagaaataatggacctgggcagtgatcatcagtgactgctaaaattgctaggtgaaagggaactttataatatcagattgaatccactgatcagtcttaacatcacaaagaagtttgcctggtgttgtgttacagaaggaagcaaacagcaccatttatgaacctagatctaatcagggctctggatacctggtcaggtatcatcaagtgttcctgattataggaaatgcggcaggtagaggaacaggtgaaataacccatggggatacagtgaaataaacagactttgagaaatttttgggacaagtgacccgggatcatcaacaataaataaataaataaataaataaataaataaataaataaatggaaagttggggcagaaggtaggggaatcctatagattaagaccataggagacattactaaatgtgatgtgtggatcttttctggatccaactttcaaaaatcacttgaaaacatttgggaacttttgacactgaatggtatttggtgttaaggcattattagtattttgataacactacaacaaaaccatatgtctctggttctcctaccctttgagtctaagtcaggggccacccaactctgtaaaagatcacatagtaaatattttaggctttgcaggtggcccctgttgcaactttaaggtgatctcttctgtaactattcaactcagcccatgcattatgaaagcaatcatagacaatatggaaactaatgagccagtcatggtgccatgtgcctgtaatcccagcaactcaggaggcagaaggaggagaattgcttgaacccgggaggtggaggttgcagtgagctgagatcctgccactgcactccagcctgggcaacaagagtgagacttcgtctcaaaaaaaaaaaaaaaaaaaaaaaaaggaactaataaactaacgagcatggttttatgccagtaaaactctgtttccagtaacaaatgacaagctataatttgttgacctctggtctaattcattgggtttgctgtcaagcctaggaatctatatttttaacaagcatgccaggtgcttatgatcaggcaaacagccctgggaggtgaatatagttatcccttccattttcacaccagaaaacaggcttaagtaggaaaaatgacttgcccagggatccacagctagaaggtagcagagctgtgtttataggggaaaatcctggctgccatgtcccctctctgccacattcaccccactggaggatgctaaggagaaacagggggagaaggctgggaagagcacaggaggagagagaagaaagtttttctgtgcattgtatccctaactcatcagtcttctttaggatgaggcagagccaaagggagtgagatagagcctgcacacgtgcagaaagcccagcggataaaaggaggatgttctggagcataatgtcaacttcctcaccaggtctgcaatccagagttgccagactttgcaaataaaaatacaggacaccttgctaaatttgaattttagacaaaaaaaaaagccaacatatttttagtatgagtatgttctatgcaatatctgggacataagtataattttttaaaatgttgttcaactgaaagtcaaatttaactgggcatcctgtgtttaatctggcagccctgctaacgtgtgaagcaaattagtaaaagcatttaacaaaatattggtgggaaaggggtcaaggtcaccccctgccaagggactatgggaatcatcaggaagctgcttacagggaaggttcagagttcacagagactgagcttctctggcttggccagatttgggaataggcacttgatgctctcctgtaagttcttggtttgtagttgaccttgacatggatatcctaaagcctgagttgatcaggtacctcttgtctctctacacaaaatctggaatcattcagaacccatctggtctctgggtataaaaggaattttatggagatagtgacattctcgttctgctccagcttgatccgtagtgtaccaggagtggtcatttttctgagaaacggtcttaataatgcaaccaggattgcattctttaattagtgctcattccccgtgagcactttcagcctcccaaatttttcaaactctcatcctctttgtgagcatgtgtgataggtcagggaaaggcaatgatcggtggaaggtaccaaggtagccgtgggctcttccccagtgcaatccaaagatctgtttccctccaagtacttatttttatttctagaatcattccttggaatatttcctgtgccttattacttacatctcttttttcagggttcagccttaaaatccttaattatctcattgagagcttgggtcagtagctaatatttcttatgcagtgcttgggcaaggtaccctatcttcatctgtgacttggggatgatagaggcttctatcacacaggaatggagagagcttaaataagggatgtatgtaacatgctgtggccagcactcattattaattaattagcactattcttattgttcatattactgtttctggctagtttatgtctggctaagttttaccatgggacgtatttgtcaataattttttaccggggaaggctttgaccactacctttcccagacagggtctctccagagaatggtattggtcaccttggaggaagatcagcatggatttttatgggaaataaggaaatttgaggaaattaggtttgttatgctgcacagtagcatataaagacacacacaatgaacagttactgtactttgtgtatatacttttgcacttaacgatgctcaatgggtttttacatacataatctcattttaggcaggctgttgcttcactcttattttgaagataaggaaactgaagtgcacagggtgttaagtgcttgtcaaaagtgacatttagaacccagggcttctgacttccaacatcatgctctttgttgtatcacaggcttcttgaaatattttattaatagtccattcctggaagaatgcagtataaacttcatccacattggttgtgctgcttggttagaattttgaagattcttctcaggggagtctccatgaccaattaatatccttctgacacttttttgctcaaatacttaagtgcattacagtttacacccaggacacttgaatttctgtctgtaaaattgaggctttcaaactggaatacctcttctgggttgtgtttaaaattatgaaatgagatacacaccagcatcaatttttaggactctgttattgaaaaattttcatcaagagaaatgttcctatattcctgacttctattttttttacatcaacaaaccaagtgcaataaaccagtctatgatattctatcacaaacataatttttcttttaaaaatattaattttttgataaatagaacttaaattaggtccactggtttccttatattcgcacttttttttttactatttttaaattttcaagtgtgatacatgattatcacaaaatttcaaacagcatagaaatatatatatatatgtgtgtgtgtgtgtttatgtgtgtgtgtgtatgtgtgtgtgtgtatatatgtatatatatatatatatatatatagcaaaaagtgggatttttctctttggtcattactcacatactatagaggaagccactggtttgttggttttccgaacatttttctatgcattttcaaggttacatggtatcactatatatttgcatctgtatccacatatacatttttacatgaataagaatactacaatatatttttcaatgccttgtgttgtcacttaatatatcttagatatatttacatatcagtacacatagctctactatattctttttaactgctgcctataactttaatggtgaacaaatttttgcctttagaatgaatgaaataaacacctttaactcagtatttttgcttacctgagtgaattatctttctaagactcctagaggtgaaattgctgggttcaaagtcacttgcacctttaatgttgacagattctaccaagctgccctcagaaaaagcagaaacatttctcaccagtggcatttgagaataactctttcctcacccctctcaaacacaagatagcaacaatttttttcagtctttcccaattgacattcagaaatgtgtttctgttgttttaattggcatcttttcatatgtttgtggccatttctagtccttttgtggatcatctgttcttaccctgtattcatttttctgctgggttgcttttcctaactaatttgaaggagcactttgtattatatggattttaattctttgtctgttacatatattgtacttttttggccatttgtcttttagctatgcttatgttgtcttttgccatgcaaaagaatttaatttttgtaagttgtatctctaaatcttattcttgatggcttcttgaacatgtgtcttatttaggaaggccttccttttctgaggataaagaatacttttctaagttttcttctaatattattattgttttgttttttatgtttagctctttaatccatctggaaatgatttttgtatatggtgtgaggtaggtatctaagcgtattttttttaatgaatagttcattgtcccaacactttaattactaagccattgtttcatatattaaattccaatatttatacatgggtctgcctctggactctctagtttgttccattaataaatttgtctaccctatgccaaaatgcaatgtgttcattacatagtttgataaaatgctttgctatctgatagagtaactctcccgtattgttctatttcaagtatatcttagtttttatcaaataattactactttagatcaattttgggttcatcttgtcaatttccatacaccatttcatttgggttttcatatatattgtgttaacttttcagattaatctaaagaagaaatgaaatatgtataacattgagtcttcctattcaaggaaatgacacaacttttcatttgttcagatcctcttttatgtttttcaatgcatttatttaaataaccttggacattttctgctaaggtttatgctgaggtgttttaaacacttctgttgttattgtacaaataatcttattttccattgtattttgaagtcattgccaccggcatgtgagaatagtttgatttttgtgtgtttctcttatttctgggtaggctgctaaatcatataatggttctaactgctttttcgttaattgtcttgaatagtcatatcatatccatacaacaggcagtttgacgttttgttttcaatatttctacctcatttaaaaaattcttgctttattgcattggttaggacctcttgaaaaatgtcacataaaattcgtgatagaagatactttgtattttcctaacgttttgtcagtaaatatgatatttagtatatttaataaaggaagttaccttctatgaattagacttttaatcagaaaaagatgttggaaatttttggcatttttgaaaatatggtttttcttcttttatcttttaatttagtaaatttaacagtaggttccccaaggttgagacattcttacatttctagggtaaaccttattgagctatatataatatggaattcttgtaatatagtgctgatttgataaatattttatttgtatttggagagtatattcataacatagttttacacacatatagataactatgtatgttgatatttattatgtaaatatacatgtaaggctgtatgttaaatttgactgattttgtcttcagggacgtttaaaccacatagaatggtttgggaaagtttctatctttttttgctttgaaaaagtataaataagacagaaaactttaatagaactcaaccagaaaactatctgaaccttctagttttttaatgtatagattttttttacaattatggtttttgtattcaacttttctatttaacttttaaaaaattaatatttttagtaaaccaataatgcatgtatactttcaaatttatggatgtaatagtcttaacattttacatttgtctcctctacatcccttattaatcttgccaaaagtttatgtaacttttgagagaactaacaattgattgtgtagatcaattctgatttttattttccttttggctggctgttttgctttgtttgttttacactgattaatcagtatttattttattttattgtttatttcttcttacttttcttgcatttgtttagtggatctttactgccttttttttttttcttgctgaatccttattaatttaattatattttcactattttaaaaataaatgcttaaatgctgtaatttttttttcaaaaattacttcagttatatttcatagatttcaagaaataggactttagttattgttacaataaatacttttacattttattttcagttttttctttaccaaataatttaattgcccaaagacaacttttaaaaaattattctttcttgttaacttttattttattatatttgatacagaaaatgtttcttatttttacttcatatttattttttatcttggaattccagttttcctttgagatttaatatgtgattggttttgatactttttttaggtaattgaaaataatgtgcaattttttaaggaagctgaaagatgcacacaatcacaacactcatatctacttattgaaacccattatttgtatttttaaagtgtatcttcatttatgttgtcttcttgatctttcaatttgtgaagcattttagttttccattataatgatagctttgtcagttttcttttatttataacttgtttttactctttatatatatatatacacacacatatacatatatatgtattatttctatatatttttataaatttttatatattgttgctatattaattggagcataaacttcatcatcgtaatggtgaattttaccagctttaaatataatattaattatgatataaatttaatataaattatttagtcttactttagtttttgacattttgaatcctttttttcacatatatatgaaacaacagacaacgtgtaaatcacaataaaagaaatgtaattggctatatatatctgtatatgcatatatatatatacatgtatatgcacatatatgcatatatgtagccaattatatttttcttttatgtatagttgtatttttagcactcttccattttcaatgttttctgccattttgttttagacatgtctattttaaataacatgcaacttgatttttctaacctaaatttctctctcatttaagaggtgatataactcatttgtacttattgtctctagtggtgttttctaagcttcattttcattttgtgctttttagtcatcattatcctactccgcctttctgtagtctttttggtattagttaaagattttggctttatttaaaaaacggtttgaaagctatatgtactatttctattctagaagctactttaaaattttagtaagcatatttaaatttaaagtgttaatctcaacaattaatcactgtaagcttcttttttcctttctataacatacagcctttatcaggcttttaattatttctatatctactcttctatgcatttatggttgaaattattggaaagtttcattccagataagtatgttagttgtatcagtggtagtactaatagcattattagtattattatttactttatgtctctattttacaggaagcctttattagtaattgtattacttttactaccaaattaacaaccattattcaaatttaaattgcatttttgtggcttatttgctctgcattttttgttatgttccaataattgcatagcttgggttatttttactgtttttctagaatatgtattcaattagcttggctcctatattttctgaaaggatgtgagtggtaagctttctgagtctttgcttgtctgaaagaagtatcttcagttttctttacactggatacaaaactatcctgattagaaagtcccaggttgaaaataacttttctggctaggcaaagtggctcacgcctgtaatcccagcactttgggaggccaaggtgggtgtataacttgtggtcaggagtttgagaccagcctgaccaatgcggtgaaaccccgtctctactgaaaatacaaaaattagccaggcatggtgtttcatgcctataatcccagctactcaggaggctaaggcaggggaatcgcttgaacccaggaagcggaggttgcagtgagcggagatcgcgccactgcactccagcctgggcagcaggagtgaaactctgtctcagaaaaaagaaagaaaagaaaagaactgctctgcaaacttgtattataatttacctcctaaaattcttcaagtggttaaggcaaacatgatttccctttttggaaacaagattgcccatctcccaacttattcgttcttaattattcattgttattatttctctaactgaccccccatagaaataagaactttaggccgggcgcggtggctcaagcctgtaatcccagcactttgggaggccgaggcaggcggatcacgaggtcagaagatcgagaccatcctgactaacacagtgaaaccccgtctctactaaaaatacaaaaaattagccgggtgtggcagcgggcacctgtagtcccagctactcgggaggctgaggcaggagaatggcgtgaacccgggaggtggagctggcagtaagccgagatcgcgccactgcactccagcttgggtgacaaagcgagactccgtctcaaaataaataaataaataaataaataaataaataagaaagaaggaaatgagaactttaagtaatacctcatccggacataaatagacaactcttttttcaatattaagtagtttttttaacaatgagttccatgtattaggcaaaagtttcagttcctgaaaatctatttactaatgatgcagttagttcctgagttttcacacatgctgtgaattttctcccacttatgctaacatctctagcctgctgggcaaagaggagttccctaatgtttttctcagtaaagggtaccctgggtgtttatccttgtcagtcacttccttttccccttggctttcagtttggcagattcacaggtggttgatatcctccttaggctatttttaaagactctccctactgtcctttgagatcttactaagaactgtggtgaattctctttctgtccatctcctaccttattagcacgtggtcttccacgcttttggaatgtctctgtctccttcacttgaaacactgagtcctaaattgtggtgagagattcgagattgtcagttagaagctaaagttctgcagatcagatgcacatggaatatactgtgccactgcagccaagaatctaacctgatgtttgcagatactgatccttggtgactggcttagtcattctgctgacttcttgctggacttgctcttaaggttagatttttctgtagtgctagattctgaaaccttctctctcacttcagattaccttgatctttctacacactgagtgccaaggaacctaccttccctcaggtgttacctctagttgctagtctagctgtctcctttatcgtaggtctccaaagtcagcatcttcacacacctctgatagaagttgcataaagctgtgactatcttagaataggatgcatcaagagtgcatctatgtgtgaagagtgcagacagataacactcattctggccatctggtcactctgtgtgcctctatctcaaccccttttaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtaaaaagggggtgcgtaggaatcttgattgggggagggctcataagagctatctcagcccagaacttggacctactgaacaagacattaggtgggatttagagccagcagagtgaatgcaggcattagtgggagcagagagcttcttagtaggaaaaaaaaaatggaactgtaggaaatgtggtgtaattgtcaaaagagcatgaaatcagaggtctaaattgagactcaagtcatgcctctgttaaatctgctacccttaaaaatcacaaatgtttcactatgacaaaaaaggaaaacagaacagctatgagtttttcaattgtgccatcttgtggaaacacccactacttagtatgcccacataatctgggtgcacaaaggttttaggtatgccaagcccagggatgtaccagatggtcaatttgggaagaccagttttataactggtagagtcatgtgtgaacgtctaggaataaaataaaccgtgtttattttattactatgtttttactatgtttattagtatgtttactgttaaacttagtaataaatagccattatattttttataattgtaatttgcaataataaaaaatgctagtaaacataaattaatagtagctgacatttagtggtaggcacttttctaagcatgttagctctattaattcagtaatttttgcaaaaacacctgttgagattcaggttaaaggaagggggtctgcttgaggtactgaaatgggctggccagggtctcacaggtaagagcctccaaagcagggacaaagcctgggctgtaatcctaggactcctctgcctccaaagcccatcaagatgcttctcagtgatgcatggaccatgccatgttgccccagggaattcagtgcagtttgtaggcagtaaggagctcagtctttcaacccagtcgacctatgaaacatccctatgaaacatcgcaattctttttatggtcttctgtttgctgggaaaatgtaaacacaagacccttttggtattgaaatcttatttgaatattcaacagagtgtctttcttcttggaagctatgtttgtctctgctctcctatgtcttgaccacttgattaagtgaattacaaagactgaaaagaaattattttttaaaacgtgtactatctcatgattcacaagctcagtggggcctgaccacatttcccaaagtagaacaaaatattttaacaatcttttaaaataatgaaagtatatatactagaacccatttgttatggtgtttaagaaattgttactgttttcgcaggggaggaagggttaggaacacacacacacacacacacacacacacacacacacacaccatgcatgcacctgaacactgcctccttgtagtttggtggccccagtaaacagaggttctgggctgaggttgctattggtcttaacagaagactcagcatctgttcttgagctggctcatagcagctaacagggtgtttgcagtttcttctaagactcacagaggcattggccttaaaggcaggctttctgccctcagccacttcccccactccacccaccatagcagccacatactgacagtctctgatcatcggtttctccatggaaatcaacaaacctggatagtccaacattagaagagacactcccaggtgcctttgatcttggcattagcagctgctactgtagttcgaactgaatcccttttcctggaggtgaaggtaatggagggtggaaatgggtctctaatatgaatggggaatataagcagctggagacttatcaggctggtaaagaaatgagccaaggggccatcgtaaactccagggtgaatataaccaggcggatgctgacacagtgatggtttgaccagccctcccaaagtcagcgtgacatgagacaatactggaaacaaggcactgttgagcagtgtagggacatgcaaaggagaaaaaagacagtgcttttacctaattagatacagactaatggtggcagagaagggaaataatatttgttcagctgctgagctagagattattctttgtatttttatcattatgaccaatctttaaatgcagaaactgaagttcggggtcagtgacttgaccaaagttatgcagtggtagagttagggagaagtgaaaaccaacctaaaaactagacaatgaagccttgaaaatgcatatattcagtgtcagtaaagaattatctttgaggaattggaaatgcattgcaaattatacacttgggtctcaagtggcctgctggggttggccaggcatgcattacttgttttcttcctactcctccttatggcttctccttcagtatgttgggccatacagtcccttttcgtggtctcatttcatccttacaacactcctgggggtggttaaggcagacatttgattccatcttacagatggacatgctgagatcctgaggttaacagacttgaactggccacccagaaggcagtggtgaatcaagcagttagtcctattgttaaggactttaagagaaactggaagcatggtttagtgcaagcagcagggaaggatgggtcttgctgcaaaagggtcctatgtaatgactcagaggcaagtgtggtgacgtgcacagagtctgcaactgggagcctgccaggaatgagagataagaggagataggcatgcaggggccagagggtgcagagctccttcatggcagtttcaaagtgaggcaggctcatgaaagggggagggacaggtcagaagcccatgtccactatcaagtgaaaaatgaatgcagctcagtcatcctgatgagattcaggactagagaagaaaagtgaggtaaaagagaagagagtatggggagtcaatggtcaatgtgggcctggcccaagaagtggagtatgaagggcagcagaggactccaccagccactgctgctcactgcactgtgcaccagacagacaaatataccagtgctgtatacagcctagcctttagcttgtgcttgtgagagcctcggctctgcatagaaactaatccgggaagttgttgctttttgccgagtctgagccacaggaccaaggctgagctttgggtgtaacttccttgttcttctcactctttcaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccctgtaaggcagtttggcaaatatatatatatatatatatatttatatatctaactatctatcaatctatatctacagagagttaccttctctagtacacagagaagctgctgatacagaaaaccacaagactttaacaactcagaaactctaaaatattaataatacaaaggaaaattccctttgacttaagctgtggcccatgcttctaatgctacggctctttggagcagaagacctggaccatgcagagagacaatctttgggatgagagctctgggacgggaggagttaaggtggtgctcagtcgctgctgtgtgtgtctgttaccccggaagctcaccacaggcacatgtggggactgcatggctgtgctcagcaaagaaatgatgcctgagcagggtccttgcctccacttcttccccatttcctccacttcaggacaatgttctaatttgtccattctaaaaagtgtaatcttgatgcttttgggaatcaatgatggcacctacgggtaaacacagaacagacaaccccacaacacaaaaccatgacaagagctgacagcatccatcctgggtgtaagcttcttgctggagttgcaaaggatgtgtctttctattctcagaacttaaagaactggactttctggagtaaaagaaccacagaagaaaaaatagctgaaacctgaaccctgccaagacactgccacctgtcttttccatcattgcaaagattccttggcctcacctcccactttcaggcccctgggaagcttagggggttaggaaacaggtccccatgttatctttgaatgtagacacagcacgctttagggttgcaatagcaagagacttggttgcttgtaggtcattataacgaatgccccctggtcctctcagtttctcatcctgcttccctagatcctagaccccacttcctgggtctctactgagtcccaggtaaaccccactgccaaggaagggagccaggtctagtgagaggctgcagcagtgagtgtttcaggaaagcaagcagtggagtgggtgagagccagcaggggagaatctacttggcacctgtgccaggccccttggcattctcctcacgtttccagcccctgggaggattgatgcatctgcctttgagctgttgtgaaaacgcaggggctgagaaatcacttttgtgggctggggtagggggaagggctgaggcttctctgggagatgtccaatgagcggccagtgctgcaggcttggaatcttaatgaggcctgagccctgaccggagagagggaaggaaacatctgtgctggggcctgctccctctgccccagcactggggaatcactgccttcctggctgctgccacataccacagtggggccgacctctgggcctccctgtcacatgaaacatggaagccaacagcctggccccacagatctcctctgctggagaggagaggatgtgttcctcccaggccacggggcccctctgccttgccccaagcacagagctacctaagggactgacctttgccacactggagctcacctcccgggggcctctggcctacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctcagattgtagccatggttgggatttgggatcaacgaggctggttagctggactgggaggggaggcaggtgagatgggaatttggtgttggttttctcactgtgctgtgctcctagcccctgaggactttgcaggaaagctgtttggattgaccacctcaaggaactcctttgctgtcctatgacaattac

SEQ ID NO: 14382 - DNA, 192956 bp, Human
  misc_feature (1)...(192956): n = A,T,C or G
gttgaactgaaaaaatgtccataatatattgctaattgcaagcaagaggctataaaactcttttattatgtatcatttttgttaaagtgcataggaaaaagacttgaataataaacaccaaaatattgcttattatctgtgttaggattaaacttttctactacttttagaattagacaacacacacccatataaagatgtcatggctggaaatgactgaccttttgtttgaatctaagtatcattcatgtcaagaccgcattgaaaataatgctgttcttaagccaggcaagtgtagacgttgtagatttcataaaagattcacactatttcatgaatcacaacttgaatcgacttctgttagccttcattttacgtctaggccctcatttctaattcttcctcagcttccatattatcaagatgtaagatgcaattgtggacatgaacatagaaacacaaccgcctcacaggtgtggggaaggaatataaaataattgtattttagagaacgaccataaaggagatggcaattttgagagaaagtaacagaactgcaatgacctagttttgtggtgttaatttaaatgtggcatcttccatgagaattttataaagggagctctcctaaaaccgagattcacaaaaacctggaagggccctacagggatcaggtgccctagctattcagcgatttgcctttgcttccctaattcctgcattgtgccactgggttacaagtgtgtgtgcgcatgcacacaggggtgtaggtttgatgacagtggtgaactgccttgactgccttcacaggctgaatcccccgcaggcagtaaccatggctagggaaaaacaggcagccgcgaggacagttccggaggagacaacaccaggctcccgtagggaaacttttgggaatggagatgggggattccatcctttgcgtgcagacccaagacttcgatggtagctcggacaagtctgtcattgtttttgtcctgggaaatgacacacgaagtgctgtaattagacacctaagaaacgattactctggagtgtgcgcgaaccgaatctggggggccggtggggagcaggtaaggggctgaaaggcaccgtctcctccagctctgtcggaagcctaaagccctctgcttctgggcgcccttaacaaacgcgccagacaggtgatgtctccgaggacgagcaggagccccccttcgcgatctgcatccagaagcctcggggagccggggccacggccggcggcagcagttcccagcctgcgcccagtcccgcagctccgcgcggcccggtcatcccgcctccatatgctccgccaccgccgcccgggcctccctcagccctcccgcagctccgcattccacgctgcggcagcgcacgctcgccgcctaggattccacacccctcccctcgtactggcgccagctcgggccccgagcgcgtcccccttggctcaccgctgggcgcgcggcggaccccgccggttgggccggttgggggtgaggctggggaggagggcgggggactgggaggcgagtaagtctcagtcgatgccaagttatctctcataaacatggtctaattcctgacacatcccttggcacatcagccgcgcattatatctctctattgctgtccaccccgctatcacctttctacgaagtaagactctgcacttacaacacatacccccctcttatctataggaacacacacagctcatatcgataccgcaagctaccaaacaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgggtgtcggggagacggctctctgcccggcggcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcaggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttgaaagaaaaaatacaataaaaaaacagacactagttattcaagattttccgctagtttttggtaaatattttcccaggagtagaattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaaacattcagactatggaaattattctcaaaataggaggagatattaaaatatctgtgtttgccttaggtcaacagaaagctgaaggtggtgatcagtgggttttatttcatctctacatagtacaaggaaaggaaactgctaaacatggactttccaaaaattatgtttgtaagattaaatgacatagtttaaaaatcttgtgatagtagttagagaatgtttgggggcagcttccacttgagagttagattttactcgaaagttaatttaaatctaaactggttaggtttttggcttcattcttctaaatatagatgtgatttagaagacctactgtagtggaatagatcaatgatgtgagcaaacgctccatgaccttcaagcttgaaggcttggctcaagttcttcagcgtctgctgttacatacagggcacattctaaggtccagaagttcactgttgcaataagcacgcatcgtcacccagatctgtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgccttctgattattagagtttaggtaagtagttttatgttatgagatatttcgctgtattatcagaataatttatatatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaagagtgccagtctatttaagaattgaaatagatcagatgttcttcatatgaattgataactgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtcttttatttaaatctttaaaagactatttgcaacaggaacgcagtattaataacacaagttgttacatatttgtgttcgttatttatattaatgaaagtgtcagctagatgctacttatctttatgctgatgatagattactcttaaagtacagtcagccaagattcttaccggctgtattcagcttcatttctatcaatttcattttattcctagttttagtccattttatttttatattggtacagttaatgttttgttcatagcagtatcaaaacaataagaaaactgacaattcaaagtcagatatgttgtttttctttgacagcctttcttgcttttggtgctgatggcttgagggaggaaataagtggaaagagaaagagaggattaagccaatgatcactagagcaagggaataaaagtgccttaagactatagatcacatttaaatttaataagatgtattatttttcatttatagtaaatagtatttgaaagactatgttttttgtctgcttagttttaagttgttgaaatgattatggtttgtatgtttgtgtatacagtaatagtcgatgtcagcataactctagaataaattacagtggagttgtagaagtaaaaataacttccacattgtaaactaatttgctagtaatgactgaattagtatatcattcgttaaatcggccaccccctactttgaaatgggaaattggaattttggggaattatttaccaatttacttaataaatgtaagataatattacttaatacaaaataaatatgcaaggctgtctgtacatggataactattttgatgctttttgaattttggactttgtaacatacagaaattatcactaaataactaattttatagcttattcagattttgtatatacatagaaaatagtctgtttaataaatttgtacctagagcatatcagcaggtactatgctttaagcttttctttttattagtatagttttaaagctgttcactttttttttatgacacgagtgttaattaagtgaggtgttgatggatatgtatcttttctaggacacttttgttcttcacatatgctgttcctcattgttagcttttcctgagtagaatttattaattaatcagtccgaattatcaaaatgttcacttaatacagatgattacatttattttatttaagttctcaactagaataatcagcaatattggttgggtacttgtttcctttatactagccacctaatattctattctaggaatgataatgagtaattacaattattttatctagtacaatgctggcacatggtagaagtgtgttcaatagatgtaatggctattattataacatttctgtttgtctctctctttttaagagaaattacacttagaggtagttgccagatgatactggttactggcattcatgatggaatagcataggagtgatgctgttgataaaattacatctaggaaaaattccctataaagtagagtgaacttaggtataatgaactagtgctgttaacccctaaagtctttgaaatacttgatgttcattagtaatttttttgtttttaggaacatcacccttttatattatgtattgatttattttagagacagggttgtattataattgtttttaggaacattactctttttattttatgtattgctttattttagagacagggttttgttagtctgttctcgcattgctataaagaactacctaagactgagtaatttatagagaaaagaggtttgattggctcacagttccgcaggctacaaggaggcatgcaggggaggcctcaggaaacttgcaatcatggtaaaaggcaaaggagaagccgaccccgtcctgcatggctggagtgggaggaagagagagaagggggagatgctacacgcttttaaacaaccagatcttgtgagaactcactcactatcacaacacaaaggggaagtctgcccccatgatccagtcacctcccgccaggtccctcctccaacactgggattacagtttgacatgagatttgggtgacggcacaaatccaaaccatgtcaagggtcttactgtgttacctaggctggtcttgaactcctgggctcaagagatcctcccacctcagcctcttaaagagctgggattacaggcatgcaccaccacacccagcttttttaaaaaaggaatgtattgcttcatgagtgaaaacaggatgtcaggattaacactttaggaattttagacatatatttattttatatggaaatgtaaggcataccttagtatagcagtatataaaaacaaatagtgcagtatgttggaaattttatgaaatgtcccataattcctaggacttgaatactattacacagtaagctcaggctattttaggataaaataatttagctcaaataaatattttattgtaccactcttttatggcagtcaaaaatttattctctgacctttttctcatttggtacatttattgacagtatgttacgtatgtagctcattgtttttctcctgctggttgtgataggttttaaaaccaattactaagtctaaccagcatttaaaaaaaattaaagactagaatagaaaatataaagtacatcaaatatagaaggaataagtattgttgtgcaaaacattgtgttttcctgtagtccttattcccatatttcttactataggttgagataaaaatagtttgaaatacttcagtgtaggtgcagctatgctatgttgactgttaaacagtgaaaatatagacagttcattttttcaaaaaggacacacgatagattagggacttactcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttctttcaatggtttattgtctcttcctttgtttttttccgtttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgccagttttaggtatcgaggaccaagaattgcttagctccttttgccctgtcttgatgagtcaagaagtctttgcataataattgttatgagagaccatcatggctcactacagcctcaacctcctgggctcaggatcctcctgtctcagcttaccaagtagctggagctacaagcatgtgccaccatgcccagctaattaaaaaatttttgtgtgtgtggagatgggggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacacttccttcctatgactgccatctctttttctaatcagtacgtagggaatggctaatcttctattggctagtgtttctttatctatcactgtatgagagcagcactttagctttcatgttaacggggcacaaagacctggctccccctttccaatcccactgtttgcctttactcttcctcatggaactgtttgcttctcttttgggattagggcctcttcactctaacctccctccctagtttcaaagtgtgttctggaaatccatgggatatttaatagatgcttgagcaaggggaaaggtttatatgaataaatcagtttgggaaaagattttagacaacatttaatgttaaaaatacagcagattatcctagaatttatgaagtttatctgactatggaataggctttttttcagagcgtctggaggatggctggcaaccagtgtttcacagaatacgctttgggaaatgttcttccagtataaggtcatggttttccttgtaacttcctgagtagcagggttagaaagaaattttgagagaaatttgggatatcgtgtggattggagagagaatccaaatctgaataggttatattttacttagtggctgtgaacttcattttctgtgtgaaagtcatgtgcactgaaagataaatttaatcatggtgaaataacatgagtgatgctgttggtaaaattacatctaagaaaagcaccctaaaaagtagagtgaaatttgacatcataatgaaccactgctgtcaacccctaaagtccttgaaattactgagagatctcttaattatgaccttttcctgctctaattaagcttacttttctttatgtgtaggcatttacattaaatacagaaattgtcactttattttttacagctttcattactgtagatgttgcaaaactattgtctatctgaagagattacattcattactttgtgatttttaagaggaaaatatcatggactcatagttttaaaatcctgttacagtgttaagtattgttttttgcagtgtaacacattttggctaggccattggtttcagacttttggactagtgtgggaactttactactatttattacatccatgaagcgctgtgtttctagtgccagcaactatttatatatactgttaaggaaactagaaaatatatacttttattaaggagaaaacataattggtgctattttggcattgtgtgaacaattaaagctgtggttactattaacttttgttcagagtttttgggaggccagataataatcatagaggacaatctagtttcattgtttaaagacagacagcatataggggaataaaattagttttctcgcttattttttttttttttttttggtagagatagggtctcactatgttgtccacgctggtcttgaactcctagcctcaagcaattctctgaccttggcctccccaaagtgctgggattacagatgtgagcagccgcacctggccttttttcttttttctgatttagatttatttttctctttaactcttcctcaccagtgccattcttcccactcctgatctaattatactgcaaagtactacttatatggatgaaaacaatcttttgaaaagattgtgaattatttcagtcatgtgcaatcatgtgttaactttcagttttatttcagattgcttaaacgtcactgtaggcttaatcaaagacaaaaacaccttctgtttaatttggtctattcatagtgataacacttaatccagtttccttagagtttccatggtgaatatctacaagtagaacacctaacctgaaatgtttctgttctaaaccaatatactggaaaagagcaaggggttttggattaagactgactgctttgattattaactgggtgatttagttatttaacctccctatgtctctttatgaaaaatggacataagactaatagtttatttttctaaaaagttaaaagttggtttaggattcttccttttctggtgatttatggttgtattttgtcagcttgcttcccattctggtttttttttttttttttttgagatacagtctcactgtgttgcccaggctggagtgcagtggcgtgatcttagctcactgcagcctctacctcccgaggtcaggcaattcttctgcctcagcctcccaaggagctgggactacaggtgcacgctgccatgcctggctaatttttttcttgtattttagtagacacaaggtttcaccatgttgcccaggttcatcttgaactcctgaactcaggcaatccaccgggctaggtctcccaaagtgctgggattttaggcatgagccaccatgcccgtcctcccattttgctttttaaaattttgataaaggaataattaaaatgccatttattggtaaataataactgaaatgcatagctatactaatataaggatgtaaataactattttactattaacatacatttgtatcttactgatagtattttattatattgggattgaagatgccaatatttctgtgtgactatgcaaaaaaatcttacaggataagctttttgcattggaacattttgttgttatataattattcttcagtaagtatcaagttaatgctcattcatccaccaacaacaacaaatatgagatgactaattacattttatttttatatttatatatctccaatctgcacatcagtggtagagttctggacctcaacgcagagggttaaaatcatcatgaaaaattattgatgtgttgttcatttaggactttttatgtattgaagattatgcagcacccgtaaatgtatttgtgacctgacagtacgacacaaacgtgtggtgtggtatgtagaaacttaatgtacactagtgtttcctaaattatatttctagagatataaatgaatattctgaaaattaagagttcagtggctgtgtaagattggaaaatagtgctttttgtatgcctctttggatattacaaagcacattatcatagaaaaagtttcaaaaagtttgctgtagaaaccatttaaactttgttttacctagaatttgcctgagtaatttaacattggaactccttatgaagaacagctgacagagtttgggaaatgctggtatatacttaaccgtaggtagtgtgagagcctttaaactggttgtgtgacagaaagtggttaataaagtcttctaacacataaattgtcacaatttatatcaatttccaaacaaaggcaaaggtttgaaggtttgcctttatcctttccatattttttagcgtatctgtttatgtcatctaagcaatattaagttggtgtggagttttgcatggggtgtatatatctttacaaagaaaggacagtgagacttgatacatgacttcgaggagtttatatgtgcacttcttggtttgcaaagatgcacctgctaagctagtgattttgtttttttccagtaaagctttattatgttctaatccagttacctctctaaccattggtacagaatttgggatcgatattgtcatggctgtgaaatagaacaatgctaattagattttatgaaagttttgtaaaagcagtatagttatcttgctacagcaagaatcccatccttaagtatcatcgtttacttagagtggctaatgcaatgccccaagttgactcagatactattaaaagcactcaagcatctacttagaagtggtatgccctgagatttaaaaaatacttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaccacttagaacatgatcctttgatcatgtcaacatcctgcttaatatacttcagtgactactgaaagctttcagaatgacatttgaactcctctttagcatgccatacagaatttttaatatgatcctgtttacttctctttttcttcactttatttatttatttagttttttgagatggagtctcgctctgtcacccaggctggagtgcaatggcacgatcttggctcactgcagcctccgccttctgggttcaagtgattctcccgcctcagcctcccgagtagctgggattataggcatccaccaccatgcctggccaatttttgtatttttagtagagatggggtttcactatgttggccaggctggtctcaaactcctgacctcgggttatccacccaccttggcctcccaaagtgctgagattacaggcgtgagccaccactcccggcagatgctatgatattttaatggctgaaaaagtggtgtcaaatttgatgatggtgatgaagaaaataattttcataatccttgaagtatatgaacttcgttgaaagagaataaagtcagcttaataagaatgacatctaaaggtatgagaggacctagtaatctttgaaagaccaaccttaagagacttctctgacagcaagaaaaatgaaagagtaaacaacaagaaatgaagacgaggtttcttgagacaacaaaccacaatgcagacattatacaaatgtgagttacttttatcctatccattttgggattaatgtaaagaataagagtaatctatacagagtaatggatttaagataaaaaaatgtttgcctcagcttcccaaagtgctgggattacaggcatgagccaccatgcctggctttttcttcacttaaaaaaattttgaaataatctcgagtttacagaaacattgcaagtatagtataatttttttcctctggaaccatttgagagtaagtagcctacctaatgctctgtcatccccatatattttctgcattcttctacctaaccacaatacaactattaaaatgaagaaattaacattggtgtatattgtcatctaatctttagggctgaattgtttaggaaggagaagggaatggccacttattatgtatgtatgtgtgtgtgtgcaattttatatttattttccactgtcatcttaaaaattatttaaagttctttaagaaatttacctatagtaaaattcacttattttggtgtgtatattgtgagttttaacaaatgtaaagtcatgtgaccactaccatagtcaaggtacagagcagttccatcatccctaaaattctcttgtgctattcttttgtcccacactcatcttttactccagctataaatgaatttgactcttttactaattaaaccataactttgattattcatgacttttcacatattggttaaattgtttggaaactcctctttcactgcaccccataggagacatttggtaatgtaggttgaatgaattatgccgttatacttgttatatgcagggctagaagcagtagctctaatcttgaaacattgtatgaaactcatatttttaatgccagggacttgtttcttctttgatttaccctattttatttcaaagtaattttttccttttaaaattatttaataattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctcggcttcccaaagtgccaggattaccggcgtgattacaggcgccaccacatgtggtcaaaagtgatttcttatatgagtagtcatttattatcccctagcagttggcaatttgtaaacaagtacttcatggtggtgaggtaaggagaagagggtgctgctatttaaaagaatgaggtaaaatgcagataatctcaaatttttcaaggtaaaagttcttagattaactctgcatttaactttatttgcacaatgtccatcataaactttagagtctggtgatgatggattgagcatacaaatataacttcatttccttctgcaattcactaacactataataaaataatttttttaaagagtcataaacctttaaggatgataagagtggtagaagagactatagaaacaaaattttggaagctgaaaagcaggtagatgagtggtaatgacttaggaggtctgagaaagtcagattccaaattagcagtggtgaaagctgaggacctgttcagtttacttggcagaatcttcagaagttttagaaattgctatctttaggaacctctggaagttgaggtatgggtagggctaaagtacagaggattgattgaggctggtttagaagcagtagaaactctagagcaattcccctgttgagtgccattgggttactttatccctctcctcaaacaaatgttggatgttcttagtacaacagaggttttctggattgggcaacataggcatagtttatggtggacatttcatattgaaaataaggagattaagtaaatttgtatttacttctgctcccagaatgctggcaactgggattaggacaggagattagaagattagaagagtcttgtctggagaatctgactctccccaagaagaaagaacttagagatgcagatatcagaggcttctcagtaaagggctcaggcagtcacactacagtgagatttgttatcagggggtttcacccaaggatttggagcttcacatcatgttttagttctcgtaattaaatatgaatggaaaatagaattgccagacatctgaggatcctcaaagcctctatagggtacagtcccaaacaaagaaagcaacccacatgaaacatacttttcagggaaagcataacttcgaaaaaaaaaaaaaacccaaaaaaaccaaatcacataaaactatcagtattttccagagatgagagaaaatcctgcaatcatgaagtcaggatgccataaaaaggagcaaaagagaatgaaaaaagttctttgaaattattatgatagctaaaatggaaacctcagtacaagattggaaagtagaaaagtggagcaaaaagccacagagagatagaaaagaggagatagaggagaaaattagaggaccaattgaggaggcctgaataataatctgatgaatgataggaattctaaaagagcactttgaaagaacagagggggaaaaaaatcatcaatacaagaaaatgttgtagaaccaaaggacacgagttcctagatagaaggggcctaccaagtacctaggtcagtggatgaaaatagattcgcatcaaggttcagaatcaatatattttgcaattcctaaaactctggggacaaacaagagaccccaaaaggttccaaagagtgtgaatacaaaggataagaatcagaaactctttggccttttcagcagcaactctagaagctagaagacagtgttcatattttgaaggaaaacagtttctaaactgaaattctatatccagacaaattcttaagtatgagggcgggataaggacatttttaggcatgaaggtgttaaaaattctgtaacctgtgggctacaaatggtttacttaggataaggagcttcccaggatgtgggacttctactaaaaccagcacagtcttaggcaaactggaatgagttgattgccttagctgcaactaggtaaaggagtgaatgaagatgaggaagtaacaggatataggaagcaggagatacaatgcaggagagagtagaaaggatttcctaagactgtaatgaagggagaatacaaaatgacaactttgcaccaagcatagaggtgaaccataacagacaggatgcagttcagaaggtttcaggacagacttaagtatctgatatggatgaacatcttgagaggagattagaaaatctggggagggtttaaggttgcttaggaaatgaagcaaatgagaaaacaataagaaaaatagaaattaggaaaggaaaagtaataacttatatggttatagtaatggaaacacttaatatttatctaactaaaattatgctgtaaccatattgggaggatggtatggaaagggaattttttttttggtggaagtgatagtaggtacggggcgtaatgtttttcctaaatcttaagtgatgattgaatgtgtatttatgaataactgataaaaatgaaaattttaaaaacagctgtagtttttacagaattaaaaagtctaaatccggctgggcacagtggctcatgcctgtaatcccagcattttgggaggccgaggtgggcagatcacgaggtcaagagattgagaccatcctagccaacatagtgaaaccctgtctgtactaaaaatacaaaaattagctgggcatggtggcacatgcctgtagtcccagctaccctggaggctgaggcaggagaatcgcttgaacccaggaggcagaggttgcagtaagccgagatcgcgccaccgcactctagcttggcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtatattctttgagcagatcagtctttttcttcttcagttatttctctgttcttatgatggcaatttatagtctttgtcttaggagtttagttgattcctaaaaaacctatgtaggttaaattcgttagtgatacacagatacttctgtgaacacacagcaaaagaacactaacagagcagtgaagacaaatcacacaaatgatgtaaatgacgcaaaggatggatatgattattatttcttaaaactaaggagctgccaggtgctatgaggaggcatcagaatacgtgtcaactatacaactgcaaaggtagctttggtttagcagcgcttacccgctcttctgatgttcaagttgatacttgtaaatgcaaagaaatgccgtgtgtgcgtgtgtgtaaattctcatagcttttggagtacaagaggtttttggttacatggatgaattgtatagtggtgaagtccaagattttagtacactcgtcacctgagtactgtacattttacccaatatatagttttttatcccttaccccctttcttccttctcccttctgagtctccacctccattatactactctgtctgcctttgtgtacccatagcttagctcccacttataagtgagaacatacggtatttggttttccattcctgagttacttcacttagaataatggcctccagctccatccaagttgttgcaaaagacattattttgttctttttatggctgagtagtattccatggtatgtgtgtatatatataccatatattctttatccctacattggttgatgggcacttaggttggttccatatctttacaattgtgaattgtgttgcaataaacatatgtgtgcaggtgtgtttttgatgtaatgacttattttcctttgagtagatacccagcagtgggattgctggatcaaatggtagatatacttttagttctttaaaaaatctccatacagttttccatagaggttgtactaacttacgttcccagtagcagtctataagtgttcgcttttcaccacatccacagcaacatctgttgtttttgactttttaataatgagaggtgccttatattaaatgaaattcctcttgtaatgaatttcaacttctcctagagaaaatcccttgaaaatctaaagaactgaccagctcttccctacatgtctgttttagggcaaggttaagagaagtttgtttcaggggattgctgaactgtaggactctgagaaaactggtccgctttctaactactcctgagtcaggttttcagaggacgagaatgacgtctttatttactttaacattatgactctttacattcagatgcatattgaaaaacacaccccaaaagaaattattattgaattatgtaatactttgcttccttgtatgagaaatcattctgtttagtttgttgactacttctgttgctcaaggtcgtttttattttccagactgtgggtcatttattttgttcatgattgcatacctaaaaatttatcttgcattttatctaaagggaaaaacatcaaaatagtagcaaagccataaaaaatttacataataaatctgtaatcattttagtttctaaatttaatgtctttgctgagaatcaatagaatttaaagcagatattaatcagtgtatctagataacattatatatttacagcttaaaatagggttaggatgaaatatttatgacagtttagtatattttgttttcaattaggtgtattactaaaaaacatgtaaaccattccatttaaaaaaagaagtaaaaggagatgatgtaatataactagtatttggaaatgacaaaggaattttccctccagctgtagaagtatttcctttgcaacagtgtttctcatttatgtttcagttctcagatatacaaagatgattgctgtgagagggcattagttttttaacagacaattaaattcagtttttgaaaaccctaattgtttagtgttcgtcaaccctaagaatttttacataaagctgcttaaatattagttaaaaagtcaagtttcattttctttccaaaattctctgcacatggctcaaactgtatttgagtctgaatttcttttgaaaatccagtaagctttatgaagaaatgccaagaaaatgtttagttcaaatttactcttctttcatagaatgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgctttcttctctgtaaagttctcagtttttgtcactgaaacctataagccactgagcggctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctccttaattttcttctgagtttttaggttatagcaccaacatactaatgacactagcttgtttatatacatgtttagccaaattatgaaaagtaaaagaaactatttacctgaggatattattacaaaaaaaatgcctcaagttgagtaagggcaattataatagtggttgaatttctggtactattttgtcataatttcacttgttattttttatgtgtttgtgtatatttcttggatgtgctttaactgttgcttgtcttcagtaccttggcaatatatatgaatttggaattgtggcacgactctggggagggaggtattctggaaaatgccatatgtgtgaaatttttacctactacactgagaaagagagattttttttgagacagataaaaaaaaacattgtatatagtcacactgctttttctcagtctgctttcttttggtgtatgtatatatttatgtatgtatatattatgtatatatatgtatatatatgtatatatatgagtgtgtgtgtatatgtatatatacacacacacacacataaaacaaaatttgccattttagcccctttaaagtgtattatttggtggtgtcaattacatttcaaaatgtataacatcaccactatttcaaaaaccttttcatcacctcaagcagaagctctgtatccattaaccaacaactctacattctctcctttccccagtttgtggtaacttctgatctactttctgtctctctgaatttctacatattgtagatattttgtataagtggaatcatttaatattattttgtgtctggcatatttcatttagcatgctattcgtaaggttcattcatgtggcattatgtgtcagaacttcattcctgtttatggctgaataatattccattgtatggctataccacattctgtttatctgttcatttgttgatggatacttgcgttgtttccaccttttggttattatgaataatgctgcagtgaacattggcatacaagtatctgtttgagtccctatttttaactcttttgcatatatgcttaggagtgatatttctgggtcatatagtaattctatgtttaactttttgaggaactgccaaactgtttttcaaagcagtggtaccgtcatacattcccaccagcaatgtatgaaggttgagttttgctacatgcttgctaacatttggtactttctgttttttgattagtcattttagtaggtatgaagtggtaggtggttcattgtggctttgatctacttccttaataattactgataacgagcagcttttcatgtgcttattggcaatttgtatatcttctttggagaaatgtctgattaaccctttgcccactttaaaagatagactatttttagaaaagttttaggttcacagtgaaattgagcagaaggtatagaaatttcttagatttccagcctccccatatgcatagtctcgcctattctttgtctatttaaaaattgcatttatcttttgttgttagagttcttcatacattctggatattctttgtcatgtatattatttacacatattttctcccattctgtaggttgctttttcactttcttgataatgtgcattaatgatatacaagtttttcattttgatgaaatccaatttgtccctttttttttttcttgtgcttttggtgtgatatttaagaatccattgccaaatccaatgtcatattggtttaccctttgcttttttccaaaagtttttttttttttttttttgatgtggggagagtctctctctgtttcccaggctggagtgcagtggcacaatgtcggctctctgcatcctccgcctcctgagttcaagcgattttcctgcttcagcctcccaagtagctgggattacaggcatgtgacaccatgcccagctaatttttgtatttttagtagatgcggggtttcaccattatggccaggctggtctcgaactcctgacctcaagtgatctgcccacctcggcctcccaaagtgctgggattacaagtgtgagccactatgcccggcctatttttttcccaaaagttttgtgtttcacttcttatatttgttatgaatccattttgagttaatttttatatatgatttgaagtaagtatccaacttcattcttttccatgtggaaattccaattgttccagatttgccatatagaaaagagattattctttctgtattgaatggactcagcatcgttgtggaagatcaactggccttagatgtttggatttttttctagactctcagttctattccattgatctatatgtttatccttctgccagtaccatacagcctggattgctatagttttgtagtaagttttgaaattgaaaagggtaagtcctctaaactgtttttccaggttattttggcttttctgggctccttgcagttccatattgtgatgattggcttttccatttctgcagaaaaggctgttggaattttgttagggctcttctttattaacaaaacccgattgactgtgttttctagctttatttccagttaggtgtggtcacgtcagtagttctggctgattgatgtacaaagtgatgtgtgatgcttaccagaagcttcattaaaaggaaggctttccccactttattcccgtctgctgcacagaacacatgtgatgttttcagagcttggactgtgatgatgagggcatgagggccatactccaaggatggcccagcagtgagctggaagcatcctggattcctgacagctttgtgaaactgccataccagcattggaccttcaaatgtcttttacttgaaaggaaaatatattttcattttgtttaaattggggttgagttttttgttagagctaaacttaatttatacacttttcctactacattaacttggttatctcttcattgtgtgtactgtgtgagggagtgagataatatattaccagaattgctggaactatacttaatttaaattttttttaatttcatgctgggcatggtgtttcatgcctgtaatcccagcactttgagaggctgaggtgggtggatcacttgaacctaggagtttgagaccagccgggcaacatggtgaaaccccatctctacaaaaatacaaaaattagccagatgtggtggtgtgcgtctatagtcccagttgctctggaggctaaggtgggaggatcgcttgagcctgggcagtgtaggttgtaataagctgagatcacaccactgtaccctagcctgggtgagaacctgtatcaaaaagaaaaaattatatttcatatatatgtattgtgaatttgactttaaaattatttttccttagtatgtaatactaaaacgttctttaacttaaatgtagcctcaacatttttttaaaaagcagaaaaaaattttcactgctgtaacatagcagatttgtcatttttgtgctaacccgttgaatattttttatatacatacttagttttctacataggaacatttctggtatttttataccttgcttttttttttcacttaatgtgataaagtgatctagtgcaagttaattaacctcctttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaattaacctctttttgcttcagtttctttctctctgaaaatgggaatagttattacacatgcttcgtggggttgttttgagcattaaataaaatattggagtaaaatgctagaccagtgcccaacatgtagtgaattcctggccctcaatgaatgttagttatcattaccattattaatatcgtgtgatcttaagctcttcttctatattattgtaaaatcttgataattacgctcttcaaagtctgcttattatttcattaaataaatacacagttatttattagatactaaatttttttttttttgagatgaagtctagctcagtcgcccaggctggagtgcagtggcgcgatctcagctcactgcaagctctgcctcccgggttcatgccattctcccgcctcagcctcccgagtagctgggactacaggtgcctgccaccacgcccagctaatttttttgtatttttagtagagacggggtttcactgtgttagccaggatggtcttgatcttctgaccttgtgatccacccgcctcagcctcccaaagtgctgggattacaggtgtgagccaccgtgcctggcctaaaatttttttaaacatttaatttacttccatttatttggtgttacaaataatgctattataaactgatctatgattaaatgtcattttattacaagctagagacacttttaaaagcagcatttatcccttattttataaggtagtgaagaaaatgtgaaatagattttgtttttctaaggcggagttttgttcttgttgcccaggctggagtgcaatggcgccatctcggctcactgcaacctccacctcccaggttcaggcgattcttctgcctcaggccaacctcccgagtagccaccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatcttttgcaataaataataatagtcacagattgtataaccagttctcataacacattataagttctgtaagcttgaggatttagtttggtttaattctctttttgtggtaatttttagaaactgtaaacatttaagtgttaaaaggtgattaagaatatgccatagtcactattttctggcatttatcactgtttttaattatatatatttgcaattatttgattattattgatcttccttactagagcagggactgtgtctgttttgcttaccagctcttccccaatacctaacataagtgcttggtgtattgtaggcactcaataaatatttatttgattaatgaaagaattggtgagtgaacaacggagttaagcaaataaatagggaataaaatgttttgatacagttaaatctcaacattgagtcagtagctatgatgaagaaataacatctaaaactccaactttagatacaattttgcagagatttggggggaatatagtaaaatataacaaggagggcaatttagagatgaagtatttaactctagggttttggttttgtttgaatgatagtggaaacatccaggtagaatgttcaggagagagaaatatgggccaaaggtcaaagggtagtcattcaaataatgacagtaattaagttcaataaattattgaatgtctaccttgtgctagctattgtatagttgtggaaggtaggtgagtaagacatattcctcataataataattcaattaaaatacctcttaccctgataattctcttcacaagtaaagttttaacaaagttagaattttgattttagaatttagtggaaagcaatgattatgaccaaattatcttaataccttgttgaattttcactgtatcttctaagtgataaagatgattttaattcagtgaactttgtagttgagacttttgttaataaaatatttttaaaaagttttactgccattctgtgtagaaataattggagcaagatttttaaaaataatcattatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcacgcctgtaatcccagcactttgggaggccaagacaggcggatcactaggtcaggagtttgagaccagcccggccaatatggtgacaccccatctctactaagaatacaaaaataagccgggcatggtggcgtgtgcctgtagtcccagctactcgggaggctgaggcagaagaatcacttgaacctgggaggcagaagttgaaatgagccgagatcgcaccactgcactccagcctgggcaacagagcgagactccgtctgaaaaaaaaaaaaattatctgttatagacctcagggctatttgttatttttaaattgtctttaaaatgaacttgaattttgtgaacattgtactttatttattgaatttatgattctgtagaagaaacaggtcaatttctggtggtacatgtcttaacttcagtattggaataaaaaaagtttaaatgatagtacagtaataagaggtagctgattacacaatacaaatgttgagggttaatagtgtgcttttggttggaacagaaaacctgatgcaaactggtttgaagaatatggaaagttttactagttaacctatcaagagcaaaagtggggtagacttcttggtttagtggctctatagtattatcaaatatccaaagtctttcagtctcactgttgttgtagtatagatttgggtgttttttttgtttgtttttgtttttaatttttgagacagagtctcactctgtcacccaggctggaatgcagtggtgtgactttggctcactacaacctccgcctcctggattcaagcgattctcctgcctcagcctcctgagtagctgggatgacaggcgcgtgccaccatgcctgggtaatttttgtatttttagtagagacggggtttcaccatgttagacaggctggttttgaactcctgacctcaagtgatccgcctgcttcggcctcccaaactgctgggattacaggcatgagccaccgcgcccagcctagacttcttttttaacactgttttccctcagggttatcagatggcaccggagcaacatgattttttgttcaggtggggaggagggaggaaggctacctgtagccctcttatttcatggaagcacctagaaagtcttccctccattctcaatgaccaaaattaggtctcctctctattcctgaaccaatataattggtattggtgccaataagattattgaggtatatgggctgtgtatgggaagtgcagtgatcttaacaaagttaggattctgtttaggaagacggaatggattctgtctagacaacaaacagtctcccctatagttggcattgtggcctacagtttatttgtatcattttcgaaaggaatttttagtgctatagtaaagctttatgctatactttgtgtttccccttcccaccccaccacctgtaactaacaccttccctaataatgtgtttttgatttagggattctgggccagtgttactgtgtgtaagagaggaaaggatgcattatagatatgtataattaaattttaattttaaaattataaatagtcattaaaatgatacctttctcagccatgccatcctttgttggcatatccctcctctgaatgcctataaaatttgtttatagtgctcatttggaaaccaatatgaatcttggattatttattgtctttttatgtatgtcataccaggatcatttcttgtatatctaggacaaataaattctattatatctgtgttactggtatctgcagaaggtgtcattaagagaagatttaaagtcaattcaataaattttttaaatgtacagtaaagtattatgtctataatggagtgtagcagcaatgaagatgaacaacatgtggttccttccctaaaggaattaaacagaattaaatgtaataaagggggcagtagagagagattactttggtgtggggagtagaaaggctcaatcatggaagtgacattttgagcttactcttaaggaattaatgttttgtgaaacagagaaaagggggcattttagatggaaaggaagctcaaaggcatgtgcttggagcatagtacttgggtgcagttgaggcatagtgggaaataaagttgaaatggtggattggggccatttcagaaggcttactacttaatttgaatttgactctatggacagtgggaagccattgaatatatatatttgtttttatttttagaggtagagtcttgctgtcactcacccaagctagagtgtagtgttgcagtcatagctcactgcagctttaaacttctgggctcaagtgagcctcccagtagctgggactataggtgcacaccaccatgcctagcttttttttttttttttttgtagagacagggtctcaccatgttgcccaggctggtctggaactcctagccccagtagtcttcccactttggcatcccatgtatttctttttaaagcaagaagacttggaaattattttccgccgaaacataagtacccttaagattcgttgttttttgccatgatacagtgtttgtggagtacacacattaattcatttattttaacagatatttattgcatacctcctatgtgacagacataaaaatctggagatacaacagtgaacgagacaggcagggtttctgctctcatggagcttacattataatttggggggaggtcaggaaatagacatgtaaataagattatttcagataatggtaagagctataaagaaaataagaggatgctgtgacagagtgttttgggtggtaatttagatgagttggttagtgaagacctctgaggatttgatgtttgaactgatgttaaatgagaaggtgccagccatgtgactatcttgggtaagagcaccctaggtagagggaacagtaagtgctgggtccttaagatggaaaaaggaacagaaggaagaccagtgtggctggattagagtgagtgaaggggagagtggtagggtatgaggtttctcctggaaaggagtttatattttcctctaagggttaaagccagtgcagagttttgagcagaagggtgatatctagatttatgctttaaaagggtaactgtggttgtcatgtgaataaaatcatgccagttaggacctttgtagcagtacacgtgagagagagagtagtgccttgaagttgggctgtagtaggggagatggaggtttgtgatatcattttatttaatttttttattttgaattattattattattatttttgaaacaagagttttgctctttttgcccaggctggagtacaatgacatgatctctccccactgcagcctccacctctggggttcaagtgattctcctgcctcagcctcccaaatagctgggattacaggcacctgccaccacacctggccaattttgtatttttagtagagacggggtttcaccacgttggccaggctggtctcgaactcctgacctcaggtgatctgcccgcctcagccttccaaagtgttgggattgcaggcatgagccaccacacctggccttaaaaattttttttttgagaccgagtcttggtctgtcacccaggctggagtgaaatggtgcagtcttggctcactgcaacccccgcctcccgggttcaagcaattctcctgcctcagcctccccaatagctgggaccacaggtgtgcaccacgcccggctaatttttgtatttttagtagagatggggttttgccatgttggctaggctggtcttgaactcccggccttaaggaatccacttgccttggcctcccaaagttctaggtttacaggcatgagccactgcacctggccgatatcattttaattttaagatttttcatttttttattttttgaggcaggatctccctctgttgcccaggctggagtatagtggcacgatcacagctcactgcagcttagacctcctgggctcaagtgatcctcccacctctgcctcccattcacttctgattgcttttattatttcatgaagttgataaaatgtaatcagctgaggatattgggaaataatgggtgattagacatttagtgagagaagagaagatttgtgtatgtttgggatcccacagaccatccccatgttaggtgctttactaggaggactgatgggacaagcatgtaatgatactcatagattaatgtttattacagtgaaaagctacaaagcaaaatcaacaaagggaaaaggctaatggagcaaagccggaggaaaccaagcacatacttccaaggatcctctcccattggaatcatacaggatgtgtttaatcccctcagtaatgaattttaatgtatagtgtgaagtattgtctgccagagaaactcattgccctacagttttgaatagctagaaggacgatgttgaacattaccaacacaaataaatgataaacgtttgagatgatggatattgtaattaccctgatctgatcaccatacgtcttatgtattgaaacatcactgtgtactccatgaatatgtataattatttgtcaattaaaaaccctgggcactgagtttatttttttattggtggctagtcacgtaggaaccctctgcctagcctctgcctagcacatactgaaattcaacaaggttgaagattcaacaaggtattaagtaatttggtcataatcatattgctttccattgaattctaaaatcaaaattctaactttgttaaaactttacttgtgaagagaattatcagggtaagaggtattttaattgaattattaatattaattgaattattatcattccttctggacttccagaaggatagtagattttcagcataaattatattatttgcagaaatagttcaggtacagtgagccattcttaccagttaggattgtgagaacactcccaaaatctaagttcccagatgccagccatagaccaaccttgcaaataggccttgctaagaaatagcagtctcaggtctgtgatgtaactcttttccgcacaatacgaaacagtacttttggagcattggagagagaccatcctaggagagagtattgagattgtcaggaatgtgtgttcatgtaaaatgtgtgatgatgacttttatcagcaagcattgatgtagtttggaagtttttccccaccaaatctcatgttgaaatgtgacccccaatgttgaaggtggggtctagtgggagatatttgggttatggagacagattttcatgaatggcttggtgtccttcctgtggttaatgtgtgagttctcgctgtgtttgttctcccaatatctgattgttaaaaagagcctgatacctccccactccccattgctcccgctcttgccacgtgacatgccagcttcttttctccatctaaaaccgcaattacttttgcatcaacctaatactatgaatgaaagcttcttgaagccctcaccataaacagatgctggtgccatgcttttttgtacagcttgcagaactgtgagccaaaataaatctctttgtaaattacccagccattcagatattcctttatagcagttcaaaatggactaatacactaatacagaaaattggtaccgggagtggaatgttgctataaagataactgaaaatgtggaagtggctttggaactggataacgtacggaggttggaagagtttggagggctaagaagatgataggaagacagggcaagtttggaacttactaaagactgattaagtggctctgataaaaatgctgatagaagaatggacaacaaagcccaagctgacgaggaatttactgggaactctggagcaaagttcacccttgttacaccttagcaaagaacttgactgcattgtgtccatgttctaggactttgtgaaaggctgatcttaagagtgatgacctagactaactggcagaagaaatttctaagcaccaaagcattcgagaatgatatgactgcttctaacagcctgtgatcaaatatgggagcaaatgaatgacttaaagttggagcttataataaaaagggaaacagcataaaattttggaaaaatctcagtctggtgcagtagtaaagaaggaagaagtgttttcaggagaggaatccaagggggctgtggagcaaccacttgctagagagagtagcatgatgaaaaggtaggtaagtgccgatattaagacagtgggaaaaaggccctgaaggcatttcagaaatcttccaggctgtccttcccattataggctcagaggcttaggaggacagaatggtttcaaggggccaggcctagggcttcaactgccttgtgccgactcaggatgctgttcttctctctgactccagctggattaataaaagcatgattgtgattttttttttctttacctatatccaagtactcaggagtaggcagagttacagttttaactagggtttgctgacataatttgaattgttcagaaatgaggtggctcctttttttacactagcgtgagacagagaaacaggtggagattttgtggattttattctcattcgataatcccatggtaaaccctaaatgatcctctttctagtgacaggaccatctaggactcacagaggatacaatttgtatggaataacctgtcaagataagcagagtatcagatactgacagtccttcattgtgacctcttatgggacgccattacctggcttggttttggcctagtaatttcctggctagatggatggaatttgggtctgttatttcaggggcatatggatagaaccaataatgtaaatttttgtttgcttttcataggcaatttgtggttattaaataattacgtaagatgtaaagtcctcagaagaagtggtgcttaacttgatatatgcatccaaataacttagtggctttttcaaaaaatatatgattgctactcacttctagagattatgactcagttaactcaggatggaagtcagtgtatgtgagtttttaaaatgcttccctgttaattccaatgtgttcttctgattaagaatcatagttccagaccatttaatgttagcttagtccttttataagttttggactctccattaatgaaactgtgtagatagtttgtattgctacctgttttgcacaagaaacaagaattttgtcaggtggggtgtgtgtctggctgggtagactggagaacgttggaccatgtttctctatccagaggtatgtaccagagaatgctttgatccagaacaaaggggatttttttttttttttttttgagatggggtctcactctgtcacccagtgacagattgcagtggcacaaccttgggtaactgcagccttctcctcctggaatcaagcgatcttcccacctcagcctcctgagtagctgtgatgacagacgtgtaccatcatgcccggctaattttttctattttgggtagagacagggttttgccatgttgcccaggctggtctcgaagtcctgagctcaagtgatccacccaccttggcctcccaacatgctgggattacagatgtaattaatcctggcctagaacaaagtggatttctaacagttaggggaacttgggtttccagcaagagaaaaatgcaatcaaatgttgctctgaagtttgggcttagggaccaacttagtatttctttaggaatcatagattaagaaaatgtgtacattctctccagtgctattagtattaaggttaggccctctcctggggatggtggtgggtagaatacttgataatcacctgctgggcctcagatttaaagcttacggacttacatgtggttcactggaaaaccaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttacaaaatatcaaaatatcctatttaatactcatcaaaccataccatcatgacatttgatgtgtcaagacaaagcattaatagaagatagtttatggattattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaatttttccaccctccgtacttctgtcctctttcctttggagtctcgagtttttttcctccatttttatctccatatgtaccctttgtttagctcccacttataaagcattttgaaaataaatataattatagcataaacattttcattacaaatagaatcttcctacctggttttcatttgctttttctatttttaggtggagagagtagtaaatgattatgataaaattttataaactattagtaaatattatcatagtattttcataggatatgaagagtaagcctgccatttttttggtgggtcaatacttttcactcatttatatttctctcgtttatgtgtatatagaaagcttatataaaactttctgtagcatttaatagcaacagatttataaatgtttgcttacaaaaatatgtacaaaaagtacaaatgagactatatgtacttttccaggaacatactgttgtatcaatatgtgtattttaagtcatggtccttagagtagtgatgttctgccactaaaatagaataatagaaatctttaatttttaggaaagattaagtcaatgggtagaattttctcaatttaaagtttttcatcccatgaattataaaaagttatttaaaaaattgtgttaaaatatatataacataaaatttactattttaaatcttttttaagtgtatagttcagtgacatcaagtacatacacattgttgtgcaaccatcctgatcatccatctcagaacattttgtgttttgctaaactgaaactgtactcattaaaaatgactttactcccactttccataccttgccctctggctactgtcattctacttcttgtctatgaatttgactactcttaagtacctcatgagtagaatcataacagtatttgtccttttttgactagcttatttcactggttctgcacttgaataaatgtaagaaccactagcaaagagtaaggtagagctgtgcttctttgctgtttgtgttttacctgctcctaagcaaacagtattactgttttaaatacttgaaaaattatttatctgcatttaaaaaataacatattaatcaagatcttagataactgccggtaataccagagagcctgttgctgctgcagtgtgtgctagaggaattctgctgtctttttgacttagctgctatcacagtcctcacatcccacatgtgtaacagtaaacactggaagttattttattttctatgcagacattttagagtattatataaacaaccgcttaattaattttggtttaaactcctaggaagtgatgaaatcacattttaacaggactgaataggaaccataaaataatttttaggtaatctctgttctcaccctaagaatattaattctgccattctaggtaatgtttactctaattcacttaaaatttttcttttccctttttttttttttttttgagacggagttttgcttttgttgcccaggctggagtgcaatggcgcaatctcgactcaccacaacctctgcctcccgggttcaagtgattctcctgcctcagctcccaagtagctgggattacaggcatgtgtcaccacgcccggctaattttgtatttttagtagagacggggtttctccatgttggtcaggctggtcgcgaactcccgacctcaagtgatccacccgcctcagcctcccaaagtgctgggattacaggcgtgagccaacatgcctggcttctcttccttttaattattagaactcttttttcctgattgactgctctggttttacccagagccaggtaggttttccccttcccattttgttattaagggacatgtgcagaggttcaggactcctgagtctttgggcagtgctgatctcactcctctgctcagcctcatgctttgtcttaaaacttaattgtctgagttggagcacttgcaaaagctctaactcaggctagtggttgggagggttctcagagacttaattgctgcctggtgctcagggcctccaggtcccactacctctggctcagtacaggcatggggaaccagccacaggagactgaccagctggagactggcaagcgtgggggctctgagctgcttccaggggccctgggacaactgcttttgagggcctcatgtctactggaccatgggatccaagagaagagcccttgcctgaaatcacaggacctggaatggggctggcagttgtacaggttggagaactgggcctggtaatccctttaggagctgtgctctgaggagctttggagtttccctggcatgtctggggtgagagtgggggaaaaaagtgactctgagggttagggcaatgacctactcacaccccacctggttttgtgtaaaaccagagcagccaatcacgagaaagcgttctaatgattgattaaaaggactgcctttttctttctttaaaccacagcaataaagggttttgctaggctaactttctcagtttggcttggcctagattttcacatggctcagtattctccacattcacatgggccatggtgtttgtggaagtgaaggattggaatttgggagaatgtggtgaggagagagacagctgacttggtgcagtatctgggctatggaacaggcactgcataactgctgatggagtcttggctaccagtagcagccggtctatcccagagaggcagaggccctgagaggcagttctgaccccctgagctgttgtgctgggatccctggcttggcatgcttaccttagaagagaagcaggctaagaaactgatctctgtctcagctaaaacaatccttcttgcatactgcagacgatccctattaggaaacagaacttccagaatgcagtccatttgtaagtttttatcattcatttataccggagagtcaattaagatcagattttttttgttaaaatataaattggcaattttagtttttaaaagatctactaaagctcaggagataatttagtgtaatagtcttcaaactgtggtatctgtatccttggtgcgtgaagactttccaagggatatgcggatgcatatagttttaagggaatcaattttcaggtctttagctttcctaattagtcttctaaaatccatctgtttgagaacagtctgaactctgtggattttctttccactcccatttcacaatgaaccatctcccatttttataaaataaaggcatatttctcacccatctcatatgttcccatggtactgtcttgtgttgtgaagatctcttaggtgtaaaacaaaagggactgtttgagaatgtgttgctcttgaaagagggcaaaagaaaaagagcttctataaaaagtattgaagcaggtattttatttcactagcttacaaaccagtggcaaaattcttatccgtcttctttcagagaactctgaagcaaaatggttgataccaggctatgtaataacacattcatttgaattaaaaattaaagtcagacttattctaatagaaaataagtctttttttatacaaggttttaattccatttagtacagtactttgtatctttttttcttttttttgagatggagtcttgctctgtggcccaggctggattacagtggcacaatctcggttcactgcaacctccacctcccaggttcaagttattctcctgcctcagccttccaggtagctgggattacaggcacacaccaccacatccggctaattttttgtatttttattagagatggggtttcaccatgttggccaggctgatcttgaactcctaacctcaagtgatctgcccaccttggcttcccaaagtgctgggattacaagtgtgagccaccgttcccggccttagtacagtatgttaaattttgtgtgtgtgtgaatcaaattattttcaagtctgcaaaaaactgtatctccacaaagaggcttaaattgctgacaaatttctggggtgataaggcagcatatttaattaaataaaagtaatgtctccaaatataaagccttcagttaaatatatcttttggaattacaaagaattaaaccacttaatttataatataaattatattactttaatatgtgaagtaagaaaatgatagttaaatatctcaactttaattttctggtatggtcagacctttacagatatttccatgctattttaactttaggatataaaacagtagcagtctactaagttttctattattaaaattagtatagaaattatcaaaatactgaaaaaactgttttatgaaagcagtacctccatcactgtaacttatttcctttcttttagaatacatcttcaaaagagaccagaatttatttaaagatagtagtttgaattttaaatttccagtcaatttttcattatctcaaaattgagctaatgaagagttgatggagttaggagaacacaggtttccaactaatgccatcaaggcagcaggatcctcacatccatgaagaccaaaagaaagatgtaatggaagagagaactacggatctgtcttccatcctaatttaaccttcaggaaataccttctgcacaaaacacttcattaaataaaaaaaattacaagacagtaagcttaaaaaaaaaaaaggctaggaccacaacttgcccagttaagtctgaatggtgatgttattggttttaagcctgaagaaaagaatgtaacttctgcttctctaaaatcacatcttcatattgggctaatttaaatttaaatcacttaatgccttaacagtgctaaaaattccaagaatgtcagacatactgatattcaaaataaagtacaaaaataagtcaaatataaatatgtttgcctgtcatgctcctctttaatttaccctgatgagctaaagttgattataattataataatatatgttatttcaagtactactattctttttaagaactcatgacctaggaccccaaaacgcaattagggatatacaatttggagtatggtttacttctcagtaaagtttaatactaattgaagtactaaattgaacaaggtcaatattttgtagtactaatcccaataacttgatcccatgcaagaaacaaaagggaattttaaaggctgttttggaatcccagaacattggggttctaccttaacttcctagtattcccttcaagtctcagttgagtgttagagaacaagtcttacttttgtcattttgacagtgaggactggctttgccaattagattatgttgtggacattttccataaattttcataaattccaggttttgatagaattctatttaaagcacatacgcaatctgaaataggttagaaattacaccatctgcatccatttaaacctataattaaacatttgagttataatttaaaagtgttcaaggcagtacattgcttttcaaaagctttgtagagacagtgtaacaacaacagaaaaatttcacaaccactgctgtagtgtagtggagaaagcctgggctctaaagtcagtcttagtggcctagtttgaatcttttctctggcaatattggcttagaagttaagttaaaaactactaagggtggctgggtgcggtggctcacgcctgtaatcccagcacttaggaaggccgaggtggctggatcacgaggtcaggagattgagaccatcctggctaatatggtgaaaccccgtctctactaaaaatacaaaaaattagccgggcgtcgtggcgggtgcctgtagtcctagctactcgggaggctgaggcaggagaatgatgtgaaccatggaggtggagcttgcagtgagccgagattgcgccactgcactccagcctgggcgacagagtgagactgtctgaaaagaaacaaacaaacaaaagttttatccagtatatctattcctagttttctaagagattttaaatttttagtaaaaactgttacagaattttatcaattgtttgcatgcattgagaggatcttaatgatttttcagtttttaaattccattatgtggtgattaacattgaagtttgaatattaaatcagttttaaattcctggattaaactcatcttgattgtgatggataacgtatttctggatttgatttactaatgctttgattaggatattttttggattatgtttgccagagagattagtctgtagtcttgtaatactgtccttgtaagttttaagtattaacattatgctgtcctcataaaaaaggatgagatgtagtccctcaaataatggtgccatttctacatttaatattgagacgtttggaaaaatttagtgataaatccatctcattctggagttttcttgaaagattttaaattatggattcaatttctttattagagataggattgtttaagttctctgttggtcatttggcaagttgagtttttctaggaatttgcccacttttaattttaaagtttattggcgtacattttttcacaatgattgtttttctgtttactctcttaatgtccataattgtacacattttttctttttctttttttttttttttttagtatttattgatcattcttgggtgtttctcggagagggggatttggcagggtcataggacaatagtggagggaaggttagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaaggcagaagaatttttcttagtatagaacaaaatggagtctcctatgtccacttctttctacacagacacagcaacaatctgatctctctttcctttccccacatttcccccctttctattagacaaaaccgccatcgtcatcatggcccgctctcaaggagctgttgggcacacctcccagacggggcggcggctgggcagaggcgccccgcacctcccggacggggtgactgccgggagggctgccccccacctcccgaacggggcggctggccgagcgggggctgccccccgacctccctcccggacggggcagctgccaggcggagacgctcctcacttcccagacggggcggctgctgggcggaggggctcctcacttctcagacggggcggccgggcagagacgctcctcacctcccagacacgctcctcacctcccagacgggttggcagtcgggcagagacgctcctcagatcccagacggggtcgcggccgggcagaggcgctcctcacatcccagacggggcggcggggcagaggcgctccccacatctcagacgatgggcggcagggcagagacgctcctcacttcctagacgtgatggcggccgggaagaggcgctcctcacttcccagactgggcggccgggcagaggggctcctcacatcccagacgatgggcagccaggcagagacgctcctcacttcccagagggggtggcggctgggcagaggctgccatctcggcactttgggaggccaaggcaggtggctgggaggtggaggttgtagcgagccgagatcaggccactgcactccagcctgggcaacattgagcactgagtgagcgagactccgtctgcaatcccggcacctcggggaggcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggggagggggaacattttttcatttctaatattgtttatttgtgtcatctgtcttttttccagcactccttttagaggtttatcaatcttgtgaatttttggtaatgttgattttctctatttaatagttgttttaattttattaacatctactctcatctgtattgtctttcttttacttttctcttttccatcttttaaagttctatgattagcttgttaatttttagcattattgttttctaatgtaagtattaagactttagatttctaaataccaccttagttgcatctcatatgttttgatatgttgtctttttattattattccattctaaatgccctctgctttctaatttttatttttgacctgtgaattgtttagagttatgtcttaatttccaatgcttttttaaaagagccattagtttaaaatattttttatttgtatcatactccagtatttaagatttaaaaatgttctgtatggttttcaaaatagtatttcttcttgtagttgtattgcatttgtgtctactagattcaggttgttacttagattgttcaaacttttgtatgcttcacttatcaattactgagacaggtgttaaaattacctagcttaatggcaagtttgccaatttttctgtgtaactcttgtcagtttttgcccattttatacattgaggctaggtcagttaggtatataaagtgtagaatttctgtgttttcctgatgaattgcacctttttctaatgacagtcattatctgtagtgaagctttttgccttaaagtttcccctttctcttcatattaatataaataatatacctttatttggatattatttacctggtttatctttgtccatacttttattttcattctttctgtattcttgtgtttggatagtttttggaaacagcatataactggatttttctcctgtggtgtgaaatctttgtattttaatggagcagggaggccatttagatttattataaatacagatttatttggatatatttctaccatttaaaaagctttttctatatttatttttccgtatgttctcactgtcttttagattaattcagtatatttgccagatttaattttcccctctagttgtttggaagacataacacttcatttctcttcggtttgagactgcccagttgaaatttccacatttaagttatgaaagtaatcactttcttttatgctcttcctaaggatcctctcctgtgacttctagtctctgtttcttttaatttagaaaaagataatctgattggaatagtttgggtcaggtgcctacttttggatcatagctattataaggtgtggaaggtggagaatttttgtggagatgtggccactggggggttcctttccttcactccttgcatctctactaccctattcatgaactgtatattgttaacttttatcagccattttaggagatatatactacggaattgctgcaaacccaaatatatgtaattccatagtctttctgtaagactatttctctcaaatttacagggtgggggaaatactcttccttttttttttttttttttttttttttggtgtatacgaatatttgaaaactatcaaaccaggaaacacctccccccaccaccacctcccaatcccaaacctgtcatctctcattggctaagctgttccaagagctttgggttatttgtgtttttttttttttttccttgtttcttccattcttttcctttggtgcttatctgagaattcctagggaactttgaggaagtgtcatcagtatttcacagttagaatgaactattgtcctaacatttcatggaggttcaggaccatggacagatcacatgtgctacctgtctcagtcccacccacatattttagcaggttaaaatattcttctgaagtctccactggcatcattcttttccttataagttgaactcctccctatttttatcagtcatcttacagccaggtcttgcctctttaaagttgttttgttgttgttgttggtttttttttttttgagacagagtttcgctcttgtcgcccaggctggagtgcagtggtgccatctcggctcaccgcagcctcagcctcctgagtgtctgggattacaggcatgcgccaccacgcccggctaattttgtatttttttagtagagatggggtttctccatgttgtcaggctggtctcgaattcccaatcctcaggtgatctgcccgccttggaggcgtgagccaccatgcccggccttttttttgagacagagtctcattctgtcacccaggctggagtgcagtggtgcaatctcgactcactgcaacctctgcctcccgggttcaagcagttctcctgcctcaacctcccgagtagctgagattacaggcatgcgccaccatgcctggctaatttttgtatttttggtagagatggggtttcaccatgtttgccaggctggtctcaaactcctgatctcaccttaggtgatccacccaccttggcctcccaaagtgctgggattacaggcgtgagccaccgtgcccaacccctctttgaagtttttatctcacttatgtataaaatacttatcttgccaatacgtttgagttagtaaatagtttagtctctgcaaagaaatggagaattagataggttaagtaacttatttaatgatggagccaggttttgcagtcaactttttctgactctgaaaccatatctctcaattacttgatatacttcattaaaaaaataattattctgttcattatactcttggtttatgactttaaaaatatgttttaaaatcaacttataatttatttttgaaattacagggccaggagcagtagctcacatctgtaatactagctattagggaggctgaggcagagggtcacttgagaccaggagtttgacaccagcctgggcaacatagtgagatcccaaatctaaaatcaaaaacaccttacacatttgcccaattttctattatagtgttcttttttttcttactatattgtaagagctccttgaattttagggatagcaaccctctgaccatcatagattacatatatttcccccatttgtattttttctttttaacttagagtatttttaaaaataaaacttcagtacataataaaactatcttttatttagttaaatcttttcctttagggtttttcttttggcattctgtttagaaaacttcttccccatccaaagaacataaaaatatccaattctgatatatctgtggtatatgtaggttacttttagattgtctatattggaactgataattttagaacacactttaagagcagtagggtaaggaccttaatatttctttttaaatgttttcttggcttttctcctacatttattcttataggtgaccttaaaattatctttacattctctttctttttccaaaatctaatttggaagaacttttaaaaagataaacaaagtggccaaactttgcttttcacttttgtcatattttaaacatatgaaagagttaaacattaatttataatagtgttcttaccagctggatagaaatacatttacttagtacctatatttattttttctttctttgtaatttatcttctaggaagctattatgtaaaatttatggtgaaccagttgttgatttatacattattagtggtgtgataactgaggatgctcgaaagaaggcatgtaatgagattgttgctatgggaagattgagtaggtaactacccagaatgtttcccatttctagtacaatatctggtattgaataggtgctcagtaaagagttaaatacatgaagagttaaatgaataatgaagactttttttgggtgaatttactaagctcgtaatttcagccttattgatcagaatcagagatacaagtatattcagtagtcttatttataggaggcaaagtagatgaactagaatgccagttaggaatttccaataaagaatatatctatcagccatcagagtcatttgtatcgttctccccactgcttttttttttcctacaggaaaaattttatcagatgtttacttgaagaatgaaactggaataaggatagctactttagtgaatttaagttctgatagcatgataggaatgatgtgccaagtggattaatatttttgcccagtgtttaacatatccctctactgtgcacaaaagactgctacctaaatttctcactcacagattttctctactgataatatctgcctcctggccacgtactttctttagctgtgtcattagctcaccattagatcttgctctgatttagtcataattatttaaaagaaaatacacaagttgtacatgaatatatgtttatttaaaaaacagtataattaacatttattgagccattttatgcaccagatatcacattaagtattatatattcttatttaattaaaaacccatttttaacccattgagggactcaaacaggtacttacatgccagtgttcatagcactggcatgtaatagccactcacaatagccaaaaaatgtaaacaccccaagtcttcattaacttgtagttggataaaatgactgtagcataagcatacagtggagtattatttagccataagaagagtgaatttctgacacatgctgtgcaacatcactgaaccttgaaaacatgcctagtgacataagccagacatacatgattctggttatactcagtatatagaataggcaaattccgtagagacagaatgtagattagtggttaccaggcatgggatgtggtggtgggtcggggaggggatggggaattattgcttaatgtttacagagttctgtgtggggtgatgaaattgtagaaatagtgatcctaatgtttgtacaacattatgaatgtaactaaagctactgatgtacacttaacaatagttaaaatggcatattttatgttatgtattttttccacaaaataaaattcaaacaactcatgacctaggttctactattatcaccattttacaagtgaggtttagaagaaataagtaactagtatgagttcatgtagttaagtgacaggcatctagacttgaactcaggtttgtctgaccccagatgccatatttttaatcaggtggttctctgctttcagaaataaaagtggaggtgccgtctttcctattccttatttccattcttttgcacagaaattacttctgattctttgcttaattgtttgacatgtatccttttagaccctcttcctatgcatttacttaagtatttatgtgcataaatgtgtacaactttttcattaatttacatacacagcataattaacattgtttatgtgactgcttttttcatttaacagtatgcattagagatgtttctattaattcatgtgggtctacttcattttatttgctgcatatgtttcattgtatggatatatgtgggtatagtgttttgtggcatggatatcccgtaatttatataccatttcggtatttcctaggtagtttccagtttttcattctaacatacagtatttcagggcttatacatatactcagaagtggagtttttgggcaaaaggaatgtacatttaaaatatttagttactgcaatataatatttcttccacttcaaaggataccagtttaaacttctaacattgggatatgagagtccttgtttcctaggaacagagtattatcagtcttttttgcctatcccatggtcagtaattgatacttgttacattagtataaaaatctctgatttacttccagatgttagacattttccatatggttttcttttgttttgaattgccagtgcctatttttctaatattaatatttctcttagtgatttgtaaaatctgtatgttctatgtgttaattttttgttacgtaaatatttgttacaaatatatttttccaatgttgttttatttttcttaaactttgttcgtgttatcttttaccttacaggagacttaagttttcatatagataaatcttctttttattattaatacttctggctataaggctctgtgttgctaaaacagctttttccatttcaatgttatgtgaatatgctccattatattttcctagtattactgtagattttaaaaaattgtttctctaattatggcattattttttgagtcgtgtgagctatggattaaagtttttttccaaatagttcatctttctcccactcatttaaaatacctatatctgagcccatttctgcttcattgttctattggttcaggggtcagcagactgacacacaagacaaatctggcctactgccttgtttttgtaaatacagatttattggaacatagccccacctatttgtttacatactgtttttgttttgattatgcaagggctgagttgaatagttggcacagagactaaagagctcacaaagcctgcaatatttactgtggcctttacagaaaaggtttgccaacccctgaattagtctcttttctaataccagacttttttttaaataaaaatatgaatatgggctgagcccagtggctcgtgcctgtaatcccagcactttgggaggccaaggtagatggattgcttgagcccaggagtttgagaccagcctgggcaacatggcaaaccctgtctctacaaaaaatacaaaaattagccaggcgtagtagcatgtgcctgtagtcgcagctacttgggaggctgaggtggaaggattgtttcagcccaggaggttgaggctgcagtgaaccgggatcacgccagtacactccagcctgaatgacagagcaagaccctgtctttaaaaaaaaaaagtgtgtgtgtgtatatatatatatgtatatatatatatacacacacactatatatatacacatactatatatatacacacactatacacacactatatatacacatatatatatacactatatatatacagaaaaaagtatacatatatacatacacatacgaaatacacatataaatgtgtattaatgggtatgtctgtctcctccccatatcacaatattttattttatttatatacaccctggtgggggcgtgtgtcttttcctaccagatatcaaaactaataaattatagtaaaaatagagtctggtattggaaaagaaaccgactaaaacagaattggcaaactttttctgtaaaggctacaataaatactttggctttgtgagctgcaccgtctgtgtgccagctattcaactcagcccttatgtcgtgaaagcaaacgaaaacaatacataaacaaatggatggggctttattccaataaaaacacctgtgttttaaacatttttcatgattattctgcatttccttttgcacctgaacttcagaaatagttaacttcaatcagataccacattaggctttcttttaaggtgaacttaaaaaaatgttacttttcagagattacattttatctacaattttgccattttaaaatacttgattaagtaatggtactagctccagtgcctgggacatggtaggtgtacaataaatacgtgctactagtatgaattgtccaagattctttctcccatgtcttttgtctggtgatatggtttagctctgtgtccccacccgaatctcatttcgaattgttaccccctcgtattgagggagggacctggtgggaggtgattggatcatggggccaatttcccccatgctgttttgtgatagtgagggagttctcacaagatttgatggttttaaaagtggcattgcccttgcttgctctcctgctgccttgtgaagaaggtgcttgcttcccttttcaccttctgccatgattgtaagttttctgaagcctccccagccatgtggaactgtaagtcaattaaacctcttttgtttataaattacccagtctcaggtagtatctttatagaagtgtgaaaacagactaatacactggaaaatcgcctgtctgatgggtatagatattcattagcaggcatctatcaccttttatctgataacatctatgtgagttacatacatgacatgatatagattgggttgtacattttttaaatgcttaagggccagcaaacattcctaaaacattaaaatatagtaatactattccttcccctctcacaggtcttctagtagatgatcttatctaagctttaagagatcactggattcctaaagtgattttattttgtagaattatgtattctgttatgtattttagtaacagattagaactaaattggatatagtagggatttcattcataaattatcattcaacactaaatgcaaattcttggctgaaggagcttatagaaacaaaatctattttgttataaaaatgcataaattaagcattttcttagtaggaccaaactttttgtgatatgttagagtgactaacttttctttcctaatcttataatatccttctatagacatttaaagctttacttctttatgccttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgccacctatcttcatagtttgttgtgtgtcttggacaagttggtatgcaaaacataaaatgtcaagcttgttaaatggagttaatctgaagattatgagtcctattctgatagcctaattgagaaaaagtgccacaaacgtgtagtttcaatttacagatgcagagataagttatagactagtgataaacttggcaaaatttccaggtaagattatctttcactggatagaattatattttgacttcatgcttaatattttttaagagcatttgcttggccataacaatacaactaacagtgatcgaaaacacaagaacatttattactaaataagtcttgaggcaggcaatcccagggttggctctctggctcagcagtgtcagtgttagattgccaggtctctgaagctcttctgtttttcctttcatggttgcaagacagctcctaaaagagcgtatcatcatagtaatatatagagtagagagagagcattcgagaaagggctttctccttgttcttcttactcattaaggaaagaccctagaagctctcaggccctttctattactggtcaaaataatataaagcaagtttcacacagatgcctgaccaaacaatggaaaaggggaaagggcttataccaattatactggcatataccaattataattcatcatctggggtaaaacaaattgccactacccagaaatagggtctgtcaatgaggaagaagggaagattagttgttaggtaactaggcagtctgccacatacgatattcatttgtttaagtaacttacaaagtaacaaggtttaaaatagtgaacaaagcggacttaatccccggaattcttgagtttttttctttctctgtttaagagatgccatttttgttgggatattattatgcattttcttgtctcctgaatgcttataagtgttagagttcaaacgaggaccttctttggaccatcagtttttaaaaatacattccttagaagaaaaacattcacttaaaaatgttttatttttacaattatgtattagtatttctagtttcagagagaaggagaaactagggtctagaggataatatacccaagttcaaatagatgggaggttctaattgtaatatcagttaataatttttgaatcttttttttttttttttaagacggagtctcgctctgtcgtcaccaggctggagtgcagtggcgtgatcttgggtcactgcaacctccacctcccggattcaagcgatactcctgcctcagcctcctgaggagctaggattacaggtgcatgccacaattccgcccgccttggcctccctcccaaagtgctgggattacaggcatgagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctgggatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggccaagattaagaatatgtacataatggactggcatatattttatttctcatgttaaagcctcttaccttgaaattaaaaaatttttaaaactgataaaacttagggcaacattaattaatgtatactcttaactgaattgttatactttttgaaaatcccgtgacttgcttgtttctctccactccaactaaatcattaactctcctaaaatgtatgtttcattctagtaagaaaacctcaaaggatattgtaggatataaatcttatttgaaaatatagccattgaaatgttttggccttttggagttggggaatgacaaatctgatcctggaatctttttcttttcagtaatcccttgtgtctgttgcctgagggacatggacaataaagcagtacatgatcctcagatatagggagaaggacaaggcatatagcttatttattagagccagcaagcatctgctcattatgtttggaattgctttctataagaaaattttgccctctactactaacttgaccaaaaatgaatttaaaattgcctgtgaaataacatcctctcaaatgtttgctgatgaaattcaagttgaaatgtattcattgcaaaagtctataaacctgtggattatatattcaaaataagacaaaggcaaataaaaagcagctgtcttcatgaatagacaaaagttgctttcaggaagtataaattatattctgcactgaccaaagaatagaagttattgcatctgtggaacatatatctggagttactatactaaagagcagggcatgaatttagactaaaatccatccagattacactcattctttaggccactgctggatacttcatttacatttgattcttggctgggcacggtggctcatgcctgtagtcccagcactttgggaggctgaggtgggtggatcacctgaggtcaggagttcgagaccagcctggccaacatggtgaaaccccgtctctactaaaaatacaaaaattagccgggcatggtggtgggctcctgtaatcccagctacttgggagcctgaggcaggagaatcacctgaacctgggaggcggagactgcagtgagccaagatcatgccattacactgcagcctgggtgcagagcgagactccgtttcaaaaaaaaaaaaaaaaaattgattctcaaggtaatgagatatcagcaaggtttgtcttgtatagtgggcataaaagaaaagttctaaattgcctctgcaatgacttgtagtcagtggaagagtatcattttccctgatcatgaccactatgctgtaaattgatataaattaactttctctggagttacacacaaataacgaagatttaagagaaccttggctgaaataaatttccagttgtttggaggctaataaataccatgcaggtgtaaccattaaaaaaattattatataaactactatattatgtaaactacaatattttagcttttctgtgtgagaaagtgatttttgtttgtttgtttgtttgagacagagtcttgctctgtcatccaggctggagtgcagtggcacgatcttggctttctgcagcctcagctcccgggttccagtgattctcttgcctcagcctcccaagtagctgggattacaggcgtgtgccaccatgcctggctaatttttgtatttttagtagagacgagatttcaccatgttagccaggctggtcttgaactactgacctcaagtgatctgcccacctctacctcacagggtgctaggattacaggcatgagccactgcacccagccaaaaatgatttcataaaaattgttaaaaatctgtagctgctttgttaccttcattaactctttgtgattaaagttgcaagtttattgcagtaatgggaatgtgttagattaatgtttaggtgagttatattttaaaatctgtgtagtatatttatagttcacccagtaattagaacaccgtatcttaattccttattgttcctctagtgtgtcacaggaggtagagtttattgatgctgggattgcggatgtgaaaataacattctcagggtatcttatgacttaaaaggccgattttttaaccagtgatattttctgtgattgtctataatttggtttaaatttatacttaataagggccagaatacatggctatattcttagtatcctttagaacattatttcttagtcaaagtttatgaggcatctagcaacattttacatgatatataaaattggaggtaaatgtgctttttcttgggaggaattcatagccttaaactattcttggaggagtgtatgattctctctctgtactttcccctgtttttcaattattgcttcagagtattttttttttaagtttgagtactttaaacagcatagagaagtaaatcagtgacttaaaaattcattattttgtcctatatgcacatgttaatatatcattacatttcagtggcagtatttttcatttcttgttttacttggttaattttcaaatctctgttctttcattatttgtatttcttctatctcttgaatcattgttacccacttcatggtatttttcagattgtattattctcttgagttcttgagggtactaatcttcccatttgttttgattgccaactttccccattttggtgttctatttcctcatttagtttaattttttttcaattgtgagctcacttttgactgaggtagatttttctgggatgagttcctttccctctgaatgcttttgcttctgtgggataggaactagatttaatattaatttcttggcagaggatttctttaccacatgggcagtatggattcagactccaaaccctcatgttttcctcttatgctgccccccaccaacaccctaggttgcttcactggacaagaatcagaatttttattattccctgacatggggaaagggtcctggttttaatgagaggtaatcattccagtcctctacctctgttaagccaccagcaataccttcattcgttgtggatcgaatgatccctaacaggcacctgttagggcctgtgtccaggacttttgcttttgcagcatctattcctgtgtttaaagttttgattatttttctttatttctaattcttggggatttctcttcctttcttctccttcattagtttgattgtatatttaaaatctctcatggttgtttgttttatttagcatttctatgtgtatttgtgtatgtgtgggtctgtgttactgcttactgtgttgtcaagcccatatatgcacaaggactattttgaaactttgtttaataataactcaggctaggtgcagtggctcaggcctgtaaccccagcattttgggaggccaaggcaggcagatcacctgaagtcaggagttcaagaccagcctggccaacatggtgaaaccccgtctctactaaaaatacaaaaattagctgggcatggtggcacgcacctgtaattacagctacttaagaggctgaggcatgagaattgcttgaatcctggaggtggaggttgcagtgaggtgagatcacaccactgcactccagcctgggcaacagagcgagactctgtctcaaaaaaaaaaagaaaaactcaattattctgttaaaaaattttaatatgaaagatactggtgcttaaaggtgaataatactgtttttaaccttcatgtgtctgtgattgtaaaaagtctcaaatataccacctgtaactttgttctttgtatattttaactcattaatgtatagtcacagtattacagaatttagacacagagcctggcataattgataacagttttaacatggctttattaactactcttttctcattcttccctattctcttctagtctcccttttgcatggattattctcttttcctgccctactgttggttccagattcttatgttattccattgcagataagggagaagaagaatggtagaatggaaacccactggagaaattcgagacgaaagagaagaaggaaaataatgggtgaagggaaggttaaaatttcttgctccagcactctctgttctcttccaggccttatcttactccttcagactctgtcttcatttctcatcttttcttctcacttatgcctctgcctttccactctctctttctattggacactttctttctgacaccatggtagctatcactagtggcttgcaatctatgttcctaccacctggccagtagttgtagggaggaaggaggttggatgggagaattgaaggagactctgttgttggatcttgggctacacagagtagggagaaagatgtaccttgcaaggtataccaggcattttgtattggaactttgagttctttttcttctagaattattcatttatctgttcattaaacagtaaacaatgaaccccaggcagtgttttaggaactcacatagaaacatactttgttcttttcagtttcagagatcttttttatttaacttagaattatttcacttttgaatctcttaatttcagcatctgtatttatttcaaaccttttgggaataaagaggcaacttgttatgttggaaaggcttttggagcctgatagatctgagttttaatcctgtctttgccacttactaggtatttaatattcaggaatttatattatctttctaaaccttttttttttttttctgtaaaatgggaagttcttagtatggtacttggcttagatggctcccaataaaataatgcctgctaagattattattatcacacagaaagtttgtccttagtaccaaatcaattttttttgtttttgtttttgttttgccaagaagtacttttaaaactagagtacattaagacaatgattaaaggattctgttttgtttatttttatatcacattcttgaagtttggacaagttgtcataatttacataaaactattacttctaagctattacttctaagttggtgtgtccttctctgagctagcagtgtcatagtagtactgtgacttactagtcaagtttaggccagcaagtcacatactatgtttaggccttataatattaatgagggttaataatatgtaccttatggattttatgataactaaattacgtattagtttggaagctaaccgtgtctagttgtgagctaaaaaccaagtatttagtgtaagattcaggcttgttcgggaaatacaaggcagggatgcaatcaaatgtcaggaatcgccagaacaccgggaataaggaagctatcggaacacttccttttctcattgtctttgcctttctctatgcatctgctttgtttttctctttcattatgtggaactgattttctcttttgcttttagagtcatagtaggatgtttgcctcaacacttgctgagtttgtatgttaattcttgtaatcatctgcagagactgactctgagttaggtttgaaattacttgtcccccagcttaggtcagatttccatattggttcagttaacactggccagttaaatggggcctcacaatatgcacttggcccacccctgagaactgagggggagattttcagaaaaagggagggaggcggcgtggcagatacctcagaaagtgtgtgccacaagtgaagtcatttaagtatacagcactgaagaaagtcaaggtattgttatcattagatgatgtagtactttgtgaaatatcactaatagcatctattcagaatagcatgtcatttatctaccagcgcaacagatctgattagtcccttatatgcccttgatttttgtcaagggcagtagcgtagtgattattatatctttttcaattgttgtaatgaatataaagtcttttgcaatttgtcttttatattcaaaattattttaatcatagagtgtgcttgaaatgaactttttggtggatataatttttaagaacatatctttgtataaaagcacttttgttaaatattgctaatgaacttttttcaggaataagttgaacgtataatcagttttttttcaaatgcagcatagaaataagaaatattcaagtaattgatacatgattcttttggttctatcattgaatttctgaactctcagctataacttgttaaggcatcttttaaattatcccagacattatgaatggagtgctcagtaatgatttgtataacccttagctttgttttgattcattttctttatactacttagggtatcatcatatgacaagataactgtatacccctgtatagacacttaatattgttaatatttattgttctgtgttcatatttaccccaaattagaatagtcaataggtataatttacctgaagtgtcagctctgcagcacactttttctgaatttctgatttagtctgggtgggggagctaggtttcggtttaaggatgcctttgttttgtgattttgtgatatagtagaaatcaaaactgcttttaagtatagaagactggtgttacaattatttggggggatagtcaggctcccattttcagttcttttttttttttttttttcccggacagggtttcaccctgttgcccaggctggagtgtagtggcgccctctaagcttactgcagccttcatctcctgggctaaagtggccctcccacttcagtctcctgagtagctgggactgcaggcacaagccaccgtgtccggccgatttttatatttgtatttttgtagagacagagttttgccacgttgcccacgctggtcttgaactcttagactcaagcaatccgtctgctttggcctcccaaagtattgggatacaggcgtgaaccaccacacccggccccatttttagttctagtaggtctgtatgtatctcccaccttgtcaaacttgtgtgtaattttttttaaaaaaggtttcacccaccttgtcaaacttgcgtgtgatttttaaaaaagttttcttccttttttttttgagacagagtctcactcaatcgcccaggctggagtgcagtggcataatcttggctcactgcaacctccgcctcctgggttctagtgattctcctgcctcagcctcccaagtagctgggattacaggcgcccatttactaccatgcccatttaatttttgtatttttggtagagacagggtttcaccatgttgaccaggctggtcttgaactcctgacctcaggtgattcacccgccttggcttcctacagtgctgggattacaggcgtgagccactgtgcccagcatcttcctattttgttttaaaacagctttactgacatgattgacataccaaacaattcacctgtttgaagtatacaattcagtggttttgatatcttactaatttttaaaaattgtggtaaaatacatataacaaaatttgccattttgaccacttttacatgtacaattcagtggcattaaattatatttataatattatgtaacaaccatcacatagctgtctctaaaactttttcattatccaaagagaaattctgtaaccattaagccataagttttcattctcctgtcccccagcccttagtaacctttaatctactttctgtctctatgaatttgcctattctagatatttcatttaagtgacataatatatttgccttttaatgcctgtcttactttacttagcatgttttcaagatttatccacattatagcacgtatcagaccttaacttcattttaaagctgcttaacatactggtgtgtgtgtgtgtgtgtgtgtgtgtgtgtgtgtgtgtgtgtgtgtctgtatatatatatcacattttgtttatctgttcatctcttgatggacatttggataatttccaccttttggctactgcgaataatgctgtcatgaacatcattgtacagatatctgtttgaatctcttcttttgattctcttgggtacataggaatggaattgctgggatatgttggtaaatctatgtttagctttttgaggaactacccaactgttttacaaagcagcagtaacattttatatcccctctagcaatgaatgagggttccagtttctccacatcctcttcatcacttgttattttctgttttatttaattaatttaaaaaattcagctattgtagaggttgtgaagtggtatctcattgtggttttggttttcatttccttaatgattagtgatgttgagtatcttttcatatgtgttttggccatttttatatatcttcatatatatattattttacttttaagttctgggatacatgtgcagaacatgcaggtttgttacataggtatacatgtgccatggtggtttgctacacctatcaacctgtcatctgtgttttaagccccgcgtgcattagttatttatctaatgctttccctcctcttggcccccaccccaacaggccccagtgtgtgatgtgcccctccctgtgtccatgtatgttctcattgttcatctcccacttatgagtgagaacatgtggtatttggttttctgttcctgtgttagtttgttgagaatgatggtttccagcttcatccatgtccctgcaaaggacatgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgatagggattgctttgaatctgtggattgctttgggtaacattgtcatattaacaatattaagtcttcttccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtgtagctaaggactacaggcatatgccaccacgttcagctaatttttttctctttctcttctctgttgtgtcaattccagatagaaatcctctctctctttcctttccttacaaaacacaaatacagaaatccctagtggacttgactaagcagtgtggaatacccgttttcgaagctagttagagctaaatgcatacttttagatcagagcaaactgtatgacctatctgtttcactcccctaatgctcaaatatgtatctttgatcttatcacactctggctccatggaaggaagagagaagacagctacacccatgtattatgatcctttaatcatatcagttcctttttgtgttagaataaagagggacctgaggagaggaaaggagacacgtttaaacttctcttagaggcagcagaatatgtaattgctctaatcattaaacatttttaatttaccagttaaaattattaataagattacatctaaattcctttaatgaaattcaaagccttttccattttctagctcttatttctttgcatttcttctcacaattctttaccatggattatttaccattaacaccccaaattcacttcctcgcctctcttcatttgcttatattgttccctcttgcctggagtatctacattgtcaaacccaggcaaagcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaacgcattttaaaggaacaaatgaatgagtgtgaaagaaacatgagtttacttggtgggaattgctgaagagctctctggtgccatgaaatctgcttttattttttatatctttgtgttaaaatatatatttaatgctgatagaatgttaaaactggtctcatttttacatcccccttgctttgcattcttttatatgttatttggagtttaaacatacatttctcaccaaaaatgtaattcatatgtaagaaataaaagaaaatatattgttttcttagggaaattaaatctgtttattctcatatagtttgggatttttaaatattttgacaattcttaaatcataatttgaatttttgtgtaactaagaaacaccattatttatatctaatttgcatcacattttattaagaaaataattgatattgctctttcatttcagctaaaccatttacttctaaagtgaaacaaatgcgattacatagagaagactttgaaatattaaaggtgattggtcgaggagcttttggggaggtaagagattaagatttgatagaaggtctgctaattattttggaagctgttgaacacaattgtgagagaatttaacaagtattgttacttgttacttgttaaacaatatttgttaagttgtgattgatgtgattgattgtgctgttgtgattgatataatagctcagaaaataaagtgttgaatgaaatatttctactgggaattttttctaagatcatgttttcacatgtacttcatatgtcaatgtaaatatgagtgtgtttctagactcttcttttgttctgttggtctgtcttattctagtttataaggaatcttgatacctggtagtgtatatactctgacttcctttttctccccctctcccatctctcctcccctgatattttcatagtattttattttatgtatgaatgtatgtatgtatgtatgtatgtatgtatgtatttatttatttatttatttttgagatggagtttccctctgttgcccaggctggagcgcagtggcatgatcttggctcactacaacctccacctcccggattcaagtgattctcctgcttcagcctcccgagtagctgggattacaggcgtccgccatcaggcccagctaatttttgtatttttagtcaagttgggtttttgccgtgttggtcaggcgggtctcaaattcctgacctcaagtgatctgcccaccttgtcctcctaaaggatattttcatagtattttagaatcagtttttcaatttcgactcacttgtaaagatacacatgcacgcgcacgcgcgcgcgctctctctcgctctctctctcgctctctctctcgctctctttctctctctccctcctctctctctcctctctcttctcttgtctcctctctctctctcttttttccaggaatttgggtaaagtttgtattgaaactggagatcagtttgcagacaattggcattttaacaatactactgagtcacctaatccatagacgtggtatattcttccatttatttagggctttataaatttatctcaataccgttttgtagtgttcattcagtatagaagacctccacatctttcagcagatttattcctggatatgtgatagtcttgatattattttaattagaattgtttgtgaaatttcatttcttaattgttttcttggtagtagttagaagtagaatttaattttattgatcttataccttgttatacttttcaaataggaattttgttgaattttattaatactttatctgcatcttttgggacactcatggtttttctcctttactttgttaatgtgttgaattatgctgttatattttcagatgttaaacaatctttgcattcctaaaataagcccaactgacttgtgatatgttaccccctttatatgtaccaacggacttcatgtgctttttgtgtgttgataggatctttgcacctgtgttcttcagataaattggcctgtaattttcctacttcgaatgttctgatcagattttggtatcttggttatactggtcttacaagaagagggaaatgttccctcctttagtattctccagaagagttagtgaagattgttattatttttttcctgatatgcttacaagatttaactggtgaagcctctgagaccagaggttgctagtgaaaaagttttaaataatgtttaatttctttaatggaaataaaatgacttgttctgtgtatgtattagttttgctaggtttatccatttcatctaatttttaaaacttgttactgtattgatcatttctctctctttttatttttcttgctaggggtttatcagtttattatcttttccatgaattaacttttggccttttgaattttgttattgtagatttgttttctggttctttaatttctgcactttataatattttctttggttttatcttgctattctttttctgatttttcaaaatagcattgatatctagcccttcttttcaaacctgtgtttaaggctatatgttttcctctaagcatttttagctatagcagacatattttggtatgtcatatatatgtatatattttttgcttaaaatacagtgtgattttaaatttttgtttttgatctatgaatttaaagttcattaaaaaaatttctaaacatttagaaaattttctagtttttcttattgagttataatgtaatttaaaagtggttagaacgcatactctatgtgattagaatcctttgaaatttgctctgcagtgttctgtaaatatcagttaggtcaagttcaaaatcttgtttaaatcttccatatccttactgtcatttcctgagggaggatttctttatttctttcagtttttgctgataacaaatgtacagttattatatcttcctggtgattaactcattcgctattatggagtgttcccatgatctctatagtgttttttgatttaaattttccttaatctgatattagtggaactactccagctcttttttattagtattttcattaaatatcttattctgtccttttcgttttagctttctataagcatatggtatgtttactgttcagtagaatataattagattttgttttttaatcagttaacatgtaatgatgttactacttgttttatatttgttttgctcattttgtgttgtttttctctcatttcttgcttcttcttcgattaatggaatattttaaatcatacctcccaattttatcttcttttatgtgttcccctggcaattaccacatgtatccttggtaaatttatattttgccaattcccatttacccaatttctaccttttttttttcattgctgtcatatattttagttccatttatatttgaaaccccaacatatatattgtacctatttatttaggtttacccacatatttgtattttctctgctcttcacattcatgtacttccctttgggatcattttccttttgacttaaaaattccctttaatagttctttttaatatttagagacaaagttttgctttgtctctctggctgcagtgcagtggtgtgatcatagctcactgcagccttgaattcctgggcccaagtgatcctcctgcctcagcatcctgggtagctaagactatagctgtgcaccagcatgcttggctaatttgtaaattttcttgtagtgacggggttttcctacgttgcctaggctggtctcaaactccaaggctcaaggagtcctcctgcctcagcctcccaaagtgctgggattacagttgtgaggcactgtgcctggccctctttagtatttcttcagtgtaagtctgctgataacaaattatctgattttatttgtctgaaaatatattttttgaggtcctaaaattaaaaaaaattgaagtatattatggtatacacacacacacatacacacacacacacacttcagtttcaaaaaatatacacacatataactcgatggatttttacatttttttagggtacaaaacaagcaatagcattttattgttatgccatttgaccatagcattctttttttattttttatttttttatttgagatggagttttgctcttgtcgcccaggctggagtgcagtggtgcaatcttggctcactgcaaccactgccacccgggttcaagtgattctcctgcctcagcttcccgagtagctgggattacaagtgcccactaccatgcctggctagtttttgtatttttagtagacatgtggtttcaccatgttggtcaggctggtctcgaactcctgacctcaggtgatgcacccatcttggcctcccaaagtgctgggattaacaggtgtgagccaccatgcctggccttattattattattttttttaatttttgtgggtacatagtaggtttatatatttatggagtacgtgagatattttggtacaggcatgcaatgcttaataattgcatcatggaaaattggatatccacgttatttcaaaatggacattcaagcatttatcctttgtgttacagaaaatccagttgtactcttagttatttcaaaatggacaactaaattattattggtcctttgtgttacaaaaaatccagttgtactcttttagttatttcagaatggacaattaaattattattgactacagtccccctcttgtgctaccaaatactaggtcttcgtcattctgttttttttgtactcattaatcatccccatctcctttttctccacatcctcaccagcatttgttattgcctgccttatggataaaagtcattttaactggggtgagatgatacctcattgtagttttgatttgcatttctctgatgatcagtgatgttgaccacttttttcatatgcctgtttgccattcgtatgtcttttttatagaaaggtctattcaaatctttagcccattttaaaaattggattatcagattgtttcctatagagttgtttgaattccttgtatattctggttattaatcccttgtcagatgagtagtttgcaaatatttcctcccattctgtgggttgtctcttcactgtggtttgattctgtctcttcactgtgggttgattgtttcctttgctgtgcagaagctttttaatttcgtgtcatcttatttgtccatttttgctttggttggctgtgttttaagaaatttttgtgcagaccagtgtcctggagattttcaccaatgttttcttttagtagttttatactttgaggtattagacttaaatctttaatccattttgatttgttttttatgtaaggtgagagatagggatcaaatttccttcttctgcatatggttatccagttttcccagcaccatttattgaagagactgtcttttccctaacattcttggcaccgttgttgaaaattagttccctgtatgtatgtggatttccttctgggttctttattctgtttcattaatctatgtgtctgtttttatgtcagtaccatgctagtttggttactgtagctctgtagtatcatttgaagtcaggtaatatgattcttccagttttgttctttttgcttgggatagctttggctattctgggtcttttgtaattccatataaattttaggattattttttctatttctgtgaaagaatgtcattaatactttgacagggattgcattgaatctgtagattgctttgggcaatatggatattttaacagtattgattcttctaacccatgtacattgaatattttttcagttttttgtgtcctcttcagtttctttcatcagtgtttcatcagtatattgatgtatgtgtgtgtgtgtgcatacctcacatgtatgtttatatacttcaattaaaaaatacacatagataacttgatgaatttttacatttttttgtaggggacaaataaataatagcattttattcttatgccatttgaccatagcatttgtgttctgtagttttcactgtagacatcttttacttctttggctgatttaaatcctaggtatttaattttatttgtggctattgtaaatgggattacttttttcatttctttttcagattgttcactgttggcatagagaaatgctactgatttttgtatgttgattttgtatcctgcaactttactgaatttgttcatcagtttgaataagtttttttgtgtgtgtgtgtggagtctttaggttttccaaaatataagaccatatcatcttcaaacaaggataatttgacttttttctttccaatttggacacctttcattctttctcttgtttaattgctctagctaatacttaaagaactatgctgtacttgaatattgatatctttctctagatttggaaagttcttattatccctttaataaactttctactcttattttctctaccttctctttaaggtcaataactcttagatttaccctttgaggttgtttcctagatcttatacatgcttcattctttttcattcttttgtcacctctgtgtattttcaaatagaccattttcaagctcactaattcttgcttctgcttgatcagttctgctattaagagactctgatacattctttaacatgtcagttgagtttttcaactctagaatttctgcttgatttttaaaaattattgtttgtttatttatttattttgagatggagtcacactctgtcacccaggttggagtgcagtggtgtgatctcggctcactgcagcctccatctcacaggttcaagcgattctcctgcttcagcctcctgagtagctgggactacaggtgcataccacgcctggctaatttttgtatttttaatagagatggggttttacagtgttggccaggctggtctcgaactcctgacgtcaggtgatccgcctgccttggcctcccaaagttttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcacgatctcagctcactgcaacctccgcctcctaagttcaagccattctcttgcctcaaccttctgagtagctgggattacaggcgtgcaccatcatgcctggctaatttttgtatttttttaaaaatagagatagggtttcaccatgttggccaggctggtctttgacctcaagtgatctgcctgcttggcctcccaaagtgctgggattacaggcatgagccactgcacctggccaaaatagcttttttttgagacaaagtctcgctctgttgcccaggctagagtgcagtgacacgatcttggctcactgcaacctctgcctcccaggttctgtgattcttccatgtcagcctgctgagtagctgggattacaggcacccaccaccacccctggctaatttttatatttttagtagagatggggtttcaccatgttggccaggctggtctcgagctcctgacctcaagtaatccacccacctcggcctcccatggtgctgggattacaggtgtgagccaccgtgcttggcccaaaatagctattttgaattctgtgtctgaaatgtcatgtgtctctgtttctctaggattgatccccagtgccttatttagttcatttggtgaggtcaggttttttggatagtgttgatgcttttagatgttttcggtgtctggacattgaagagttaggtatttattgtagactttgcagtctgggcttgtttgtacctgtctttcttgggaaagcattccaggtatttgaagggacttgggctcaaaggccaataacacagtggtttttgcagtcttatataggtattgtcttggtggtcttggataagatccaaaagttttctctggattaccaggcaaaaactcttattcttttactttactttcttccaaacatattgggtctttctttctgtatcgagccacctggaactctggggatttggtgatacaagcacccctgtggccaccatcactgggactgtgctgggtcagacctgaagccagcacagcactgggccttgcccaaggcccttcccttcagggtggtgagtttccccaggccccgggtgtgtccagagatcctgtctggtagcctgcgattctagttaaaaaccttagcaatctacctgatgttttatttttactacgtctgtgctggcattcaaaccacaatacaaaaagttcttcccgctcttctctcccctttccacatgcagaggaggagcgtctctctgtggccagcaccatgactgttccatgagcagttctgccaggccacaccaccagtgttcacttaaagcccaagagctctttcatcagcttgtggtgagtgctgccaggcctcggactcacccttcaggcagtgggcccccctctggcccagagccggtccagaaatggtgtccaagaggctggacttggggatctgaaaagcctgccttttgttctgtcccactgtgatacctgaaagcaagacaaagttccctttacttttccctctgcttttctcagacagaaggagtctttcacagtggccaccacaactgggaatgtgctgggtctcctttgaagcaagtagtctcagacctcaaggcccacagcatactccctgggtattgctggtgcccagtggcaattcattgcccaagaactctttagtcagcaggtgatgagtcctgccaggactggatccttctcttcaaggcagccggttcccttttggcccagagtgtgtctagaaatatcattggggagctagggcctggaatgggggcctcatggctctgcctggtgctctgttctagtgtggctgagctagtatccaagatgcaagacaatgtcggggctgggcatggtggcttacgcctgtaatctcagcactttgggaggccaaggtgggcagatcacctgaggtcaggagtttgagaccagcctggccaacatggtgaaaccctgtctctactacaaatacaaaaattagctgggtgaggtggcacgtgcctgtggtcccagctactcgggaggctgagacaggagaattgcttgaacttgggaggcagaggttggcagtgagctgagatggcaccactgtactccagcccaggcgacagagtgagactccgtctcaaaaaaaaaaaaaaaaaaaaaaaaaaaaaagatgcaagacaaagtcctctttactctttgctcttctgttcttaagcagaaggaaggagtcactctggttcctgtgagctgcactgcctgggttgggggatggacagctgatgcctccctaggtcatgtgcaaccctagttcactggctctaagcactaggagttgcctaggaattggagtccttgttagaacccaacttgactgccattcaggtttacctaggaccccagagcacttcagcctgcagtggtgatgcttgctgggaaactcgttctgacttgctgggatgggtgactcccctttggctagagctagtcaaatgcccctccaagcatggccactggctgagcccagcagggcttcattctctgctgtgacagggcagcactgagtctctgcgctttccctccctgaagtatattctctctctctacctcatggccattgccagggaataggaaataggggtggcatccatgattcaagactgtctctcctgtcttcctcaatgcctttttttcaagatatgaagttaaaaccaggtactgtgattgcttacctgagttttggttcttgtgagagtgcttttctctttgcagatagtttttaaaatttgctgttccagcatggtgtgggagagcttgaatggtgtaggcttctattctgctaccttgcttcacccctggccatagccagatttttacatttgtatgagtttgtataaaccatcaagcagatcaagatatagtacatttctagcattctgataggctcccattgcccccccccgaccatgtgaataatcacttccttgttaactattctgttaactattctgacttctatcaccatagattttttttgcttgtttttgagttttatgttaatggaattatgtaatatatactctggtttctggcttcttgtgctcaacagtacacttttgtaattcattcttgtttttcactggttcacagtatttttcttaatatgaatatgtcacaagttatttattaatggtgttcaagttgtttatggtttttggccattatgaataatgctgttagaaacatttttgtgcatatcttttgggagctatgagcacttatttgtgtttgatacaaatttagaattgctgggtcacagggtaggcttatttagctttagcagataatgccaaataacttcccaagtggttaatgatttatattcccgtcaacagtgtataaaggtcccagttgctttataacctcgctaacatgggtctttttttttttttactttagtttttttttggtgagtgagtggccgtattgtgttatttcatttcgcatttcttgatagcgcctacatttgaacacattttcatatcacctcacatcacttagatatcctttccatgaagtacacattttggggttgggtaagtaggagttgcatgggtgagttgtctgacttatcgtcatattctagattcaaatctgttgttggagatgtgcacacgtgtgtgtgtgtgtgtgtgtgtgtgtgtgtgtgtgacaaatcttttccgtggcttggcatttccctctctccaaagatcttgtattgaacagaaattcttaatgttaatggagtgcaattaattaaacttttacttataattagtgatttttgtgtttttaagaagtttttttctaacctcaaggtcatgaacatattttccaataattaaaataaattctttctttgatctttcaagacaaacctttcacatttagatgtctcatctctctggtattgactgttttgtgttttctgaggtataggtcaaagttcactttattctttgtggtttctgattattgtttgttttaaagactacctttttcacatttaattgcaaagaaacttttaagttgggcccctatgtgtgccacttattaattttttaaaaacagttttcaatgtagaagtcttttttaaaaacagttcttaaggtcaggggtacacttgcaggtttgttaaataagtaaacttgtgtcatgggcatttgttgtacagattatttcatcgccctattaagctcagtacccatcagttattttttcctgatcctctccctcctcccaccctctgtcctctgacaggtcccagtgtgtgttgttcccttctatgtgtccatgtgtactcatcatttagctcccacttacaagtgagaacatggggtatttggttttctgttcctgtgttagtttgcagagcataatggcctccggctccatccatgtccctgcaaaggacatgatctcattttttttctgtggctgcatagcattccatggtgtatatgtaccacatttaaaaatctagtctaccattctgggcatttaggttgattccatgtctttgctattgtgaatagtgctgcagtgaatgtatgtgtgcttgtgtctttataagagaacaatttatattcctttgggtatatacccaagtaatgggattgttgggtcaaatggtgtttctgtttttgttctttgaggaatatttttcaatgtagatgtcttgttcatgtttcactaaatttatgggtctgatttcttttttttatctgccccaatccaattctttttttatttaatttttttgagtctgatgttttttagtaagctagtaaaggatagttttagaattctattttttattttcttgctgtggtagaaatacaattggctttaaaaatattaatcttttatttaaggaacttgattatattaacttcttctagtttgtacataaattttttgaattctctatatgttcatcttgatcttcaattaatgatagcatttgttcttcccaatatttattccttttatttctttttcctctattattgtaatagagaagatctttaataaaatgttgaatttaagtgctgaaagtgggcatcatccttgtctggtttgtgaatcaggagaaagtgttcagcattttactaatgattaagaagtttgctactactacttttcaaaaaaatgattactctttttccttcttgccctagtctgtagatagcttttatcattaataggagctaacttttatcaaaagctccatctatatctgttttgatatgattttactatgatatttggctaatattgatattataattttcaaatataccaatattacagtactatagaaattcagttggccttttaatatatagttgggtttgatttgctgatattttgtttataatttttttgtttatgtgcatgagacagattggcctttgtctattttataatcttacattttggaacgatattatttaagctcataagacaatttggaaagtgttttttctcaattctctgaaagcatttgtgtaagattggtgttatttctttttaataatgccaagaagacctcactggtgaagccatatgaacaaggagcacaaaatctttttgttgtttgtttagatcttctgaggaaaattttacatacattgaaataccctaattgtatatatacagttccttgaggttttggaaaatggatcacccttatcaagatacagaatatttctgtcaccctgggaagttttcttcctcgttggttccccacagcttccatcaaatggcaaccgctgttctgagttttaactgtagattaattttgactgtttgaaaatttcatataaatggaattatacagtatgtactcttttgtgtccacctttcactcaggataatgtccaagactcatccttgcaattgcatgtattaatcgtttttattactgagcagtataccattttatcaatgttccacagtttattcattttcctattgatgaacatttgtttccaattttttggctattagaaataaagctgatatgaatattctcctacaggtttttatggaaatatgtttttgttttctttgggtaaataaccagaagtggaactgctatgctaggcagtagttgcatgtttaaatttaaaagaaactggcatactacttccagttggattgtaccatttttatattcctacttatgccctgttcttgcctaatattttttgttgttaatattaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttttgctcagtctttagaaattgaaatgtttgtatttttattgttgagctgtaggagttctttgtcagatgttttagcaatattttctcagactgtgtggtttgttcattttttaaaaaaattatcgtttagagcagaagttttcaattttgaaggtataattttatcaattgttttctattacagttagtattttctgtgttctaagaaatccttgtttatactcagatcacaaagatatctatgttttttttttctaaaagccttctatttttagctactatatttagattggtgatccatctcaaattcatgtctgatgtgatatcggcattgagattcatttttttttttgtatttgtagccagttgtttcagcaccatttgttgaaaaggctgttttccctttattaagtcattttagcaccttagtaaaaagaccatgtgctctattgctgtcctctctattctctttatctcattgtctgcctttatgctaataccacagtcttgattcctatagctttatactaatgttgagattgtgtaatgaactctgagtgtatggagtcctactttgttctttttcaagattgttttaattattcgaagacttttgcattttagaatcaatatatcaatttttataaaagcctactgatgtaattgagtatgcactgagtacatagataaattttgggaggaccaatatcttaataatgttgagtctgttagtctctgaagcagatatttctctttgttttttgaaggtctaacttaattttctcaaggatgttttatagttttaatgtataggtcttcttcatattttcttaaatttattcctaagtatttaagttttttgactctgataaatgatatctttaaaatttttacattcaaacactatgctgctaatatgtagataatatagttgatttttgtatcagactttatttcctacctactaaagtcatttattttttagtagttttgttgttattttggtccctggtttcttagtttttctgtgtaagcagtcctgctgtctgataataggattttcagaatagggacgcatcctttttactttgtagactttctatttctttgtcttgacttactgcactagctcggacctctaatacagtgttgaaatggtgtcacaagggtggacatccttaccttattcctgaactgagggaggaagaattcagtgttttactgttaagtatggtgaaattattgttaggcaatattttggtaggtgccttttatctgattgaagatattgtcttctgttactataatagtttgctgagcatttaaaaaatatagttattgataggtgctgaattctgtcatatgctttttctgtatctattgaaatcattatatggattttttctttcagttagttgacatagtggattactttgattaattttttaatagactttatattttagagcagttttaagttcacagcaaaattgagcagaaaatacagagttcccgtatacctcctgttcccacacttacccaatcttcatctcccaaaacactgaaccagaatggtacatttgttacaatccaggaaactacattgacatattattattacccaaagtctgtagtttaccttagggttcactcctgatgttgtacgttcagtgggttttgacaaatgtatgttatgtatctgccattgtagtatcaaacagagtagtttccactgccctagaaatcttctgtgctctgtctgtttattcatttctccctcaccactgacccctggccaccactggtctttttttataatctccatacttttgccttttccagaatagttagaatgatacagtatgtagcctgttcagattggcttttctcagtaatatgaatttatggttcctctacatctttaaatggcttgatagctcttttctttttagtgctgaataatattacattgtctagatacactgtgtgcattgaacattccatgtacacttgaaaagaatgttttttctacatttattgtttgttgtgttttatacatcagttagctctagacggttgatgcagtcattaagctcttccataatttcctaatttttgtttagttctgtcagtgctgagaagagggttttaaagttttcaaatataattgtgggtatgtctgtatttccctgtagtttcctctctttttattttatgcattttgaaacttaattggtgcatacatgttccaattgttcatctttcttatacactgagcctttaatcatgcaatgtttcccttcaaggtagtactcgttgtcatagtctgatttgcctcagtatagccagctttcttatgatattaacctttttcatatagttaggttttatattttttacatattctgataatctgtattttaagtggactgtttagactgtgggtcaacaaactttttctgtaaagtgacagtaaatattttagatttcacagttcatatgttctctgtggcaactactcttctctgtcattgtggtgtgaaaactagccatagacagtttgcaaatgaatgatggatgtggttgtattcaaataaaattttatttttaaaaacaggtaatggaccagatttgaccttcaggccatggtttgctgaaacctggtttagatgttgtgtttgtttgtttgtttgtttttttaatgagacagggtctcgccagtgtagtggtgccatcatagctcactgtagcctcaaactcctgggctcaagctatcttcccactcagcctcataagtagctgggactacaggtgtgccccaccatgtccggctaattaaaaattaaaaaaaaaaatagagatgggggtctcactttgttgcccaggctggtcttgaactcctggcctcaagtgatcctcctgcctatgcctcccaaagtgttgggattacagacatgagccactgtattccgctagaaataaaacttttttttttttttttttttttgagacagagttttgctcttctttcccaggctagagtgcaatggcacgatctcagcccactgcaacctccacccctgggttcaagcaattctcctgtcttagcctcccgagtagttgggattacaggcatgcaccaccacgcctggctaattttgtattcttagtagagacagggtttctccatgttggtcaggctggtctctaactccgacctcaggtgatccgcccgcctcggcctcccaaagtgctgggattacaggcatgagcccccgcgcctggccaataaaacttttaataaatggtcctgagacaactggataaccatttggaaaagtccatttgtggaacaagttaaaactcttacatattccaggacaaaccacagatggatcaaaattcaagtgtaaaaaataagagaaacacaacccaaatatctgacattaggcaaccggttgaataaactattggtatagtgatagaatagaataccgtgtagctgcagtcaagaaagttcactgtacctatgtagcgcgatctccagaatgtattgtaaagtgaataaaataagatgcagaatagtatttaagtgtgtcttttttttgttaaacagaggtaggtagaaatattgtttacacttgtatttttatacagtaacaataataggtagtcgagggaatggggtagacaggagtgggagtgacacttataagtgggagcctttttatttttgttctgattttttaaagcatgtaaatgtattactcattttaagataccatgtaataacttttccagattgagctgaattcatgcaagttccatgaatcatttaaggaagaagtaattctaaacttaaacttccccagataatagaagaagaaggaccattgcccaagtcattttatgagactagaatgaccttgattctaaaacctgacatgaagcaacataggaaagaatacatatgagacgctttttttttttttttttttttgtggagaccgggtctcattctgtcatcgaggctggagtgcagtggcacaattacagctcactgtagcctcgacctcttgagctcagttgatcctcatacctcagcttcctgagtagctggtaccacaggcatgtgtcaccacaactggctaacttttgtattttttgtagaggtggagttttgccatgttgcccaggctcgtctcacacctcggtctcccaaagtgctgggattacaggcatgagccactgtgcccggccttatatgatatgcctctgtcacaaaagtcgggatcatggttaactccattggaaaggtgggggttgtgatcgggtagggctgtaggggcagggttctgtgttattgcatgttctatttcttgatctgagttttagttatatgttgttcactttatcattgtataaacataatttgttttgtagttgtatgtaggtatgttatgatcaattataaatggtataagataatttaaaaagaaggtttaataattatggaacatatgtcttacaaattatttttaaaatatatacactaacacttgatagatggaacttgtatgaggaaatacaaaaactttgaatagtttaagattagcacttttaatattcctatatcataaattgataagcagataaaaaatcaagacatagaggtatttgttttttttgaagggagaaacttttaatggcacagttattccaattccacgttaagatgattggtaaagtagtgatttttaaaaacagcaaaagctggtttctcccaaattagtttccccaagggattagaggtcagtctgtcattcagtcaaatctatatccagtagggaccacccagttttgttttaggctagtctgttgggatatatagtctgcaactagcagagttgcagctctaacaagtgttagaaatgttcattcacagaatcacctgaggtacatagaaaataaagcttctattaaaagaattatgctacagaaaagaacagagaggatatatatacaacacaggaagactcagctgattcagggaccccaggagaaagtggctttcttcatttaaaaagctacttaccatctctcctgttaacttattccaaatctagaaagaaagtacttgccaagagatactgattatatatgggaatttaaatcctccttgttaggaattccactagcaattcttttggaaaacctgaaatcaaaccatttaggttctcacagagttttactctctggagatgctctggttgggaggttggttggagtaggagttggagcagcaagcattgcgtagaatgctagtctgtgtgaaagtccttattaggaaattaaaagggttcactttgccttgtcagcggtgaaaatcagccctcaaggaggctgagaggtagccaggtttggagttatttcctttgttagggaactctatctaacccccaaaacataattcaaatagtatacacaaaagtttggtttagtccagttcttcaggccctgaagcacattagccattgtctaaactcttgaattatatctgaactaaaagaataaaaggacttctcacccatccccacttgctatattcaacttgccatatttaaaaaaatactcaactcgccatatttaagaaaaaacttttgcaggactggctggacagactacatactaaaactttttctagtactgatcagtgtgtgagatttctaaccaggatttctgatttgattccatagtggcctttttctgagagaattcgaagaaggcattgtcaccctagtcagttttctaggaattgacagtcagccagtagggggtggcagtcttcattctcccagaccaggctgcagatggtgtaggttctcctcatttctttggtgtcatgttggacccttcagactttgattgctggaaatcagcatacacagagaaggctccatctgctggaccattcttgtaaatatcagccatgatctctacacttgaaggtttactgtaaaacagaggtgtccaatcttttggcttccttgggccacattggaaaaagaattgtcttgggccacagataaaatacactaacactaacgatagctaatgagctaaaaaaaaaaaaaaatcacaaaatctcatactgttttaagaaagtttacgtatttgtgttgggtcatattcaaagccgttctgggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcatagaggctacctgagagagaacaggcttttcttggttcagaaattctaggtttgagaaggaaagcctacatacagccatctccacactgcacaataggtgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggatcagcattttttgggcagacccattttcttaacaaactgtactctctgaggcagcttggatctatccaggaaagtttccactagttaatttgcatagctcatgttggcattatggagactcaacagtttatctgcagggtgtgaaattggggtattagtcagcaccgtaaggcagaaaaggtggccagacccactctttgggctctggatcctggatttactgaaaccgcagataccctgagcctgaagatgccatgtccagtcctaatacctggttcctggaacccacctccaccactgttgccacttgaacaacataaaaaaatattttaaggacatgttatcttgctgaacctaaaagataaatagagaattctacatgctgcagagactacacattcttttctagcttatttatgtatttatttatttaaaattgagacagagtctcgtcctgtcacccaggcaggagtgcagcagtgtgatctcggctaactgcaacttccacctcctaggttcaagtgattctcctgcctcagcctcctgagtagctgggattacaggggtccgccaccacgcctggctaatttttgtatttttagtagagatggggtttcaccatgttgaccaggctgatctcaaactcctgacctcaggtgatctgcccacctcagcctccaaaattctgtgattacaggcgtgagccaccgtgcctggcccaaaatggctctttgaaagggttaataggatatttaaaaattgttggggtcttgggaggaaaatcacatgattatttcaataaaggaaaaacataactttgataggtatatgttacaagaactcagaaaataggaataaaggggaatatccttaacttgataaaggatttatgccaataacctaaagcaaaccttttatggagaaactttagatgcattctgtctaagatcaggaacaggacaaagatggttaacactattacagctttatatgttactggaggtcctagatagtccattaagaaaagaaatagaggccgggcgtggtggctcatgcctgtaatcctagcactttgggaggccaaggtgggcggatcacaaggtcaggagattgagaccatcctggccaacgtggtgaaattctgtaacatctctactaaaataaaaataaaaataaaaaaatagcggttctaagatggccgaataggaacagctccagtctgcagctcccagcgtgagtgacgcagaagacaggtgatttctgcatttccaactgagcacatggcacaccaggacatcatatcccgcacctggctcggagggtcccacgcccatggagcctcgctcactgctagcacagcagtctgagatcgaactgcaaggtggcagagaggctcggggaggcgtgtccgccattgctgaggcttgagtagctttgaagggagtagtgcttctcccagcaaggagtttgagatctgagaatggacagactgcctcctcaagtgggtccctgacacacgagtagcctaactgggagacacctcccagtaggggccgactgacacctcatacagccgggtttccctctgagacgaagcttccagaagaaggatcagacagcaatattagccgttctgcaatatttgctgttctgcagcctctgctggtgatacctaggcaaatggtctggagtggacctccagcaaactccagcagacctgcggctgagggtcctgactgttagaaggaagactaacaaacagaaaggacatccacaccaaaaccccatctgtacatcaccatcatcaaagaccaaaggtagataaaaccacaaagatggggagaaaccagagcagaagagctgaaaattctaaaaatcagagcacctcttctcctccaaaggaacgcagctccttgccagcaacggaacaaagctggacggacaaagctgcaggcatcacgctgcctgacttcaaactatacacaaggctacagtaaccaaaacagcatggtactggtaccaaaacagagatacagaccaatggaacagaatagagcccctagaaataataccacacatctacaatctgatctttgacaaaccggacaaaaacaagaaatggggaaaggattccctatttaataaatggtgctgggaaaaccggctagccatatgtaaaaagctgaaactggatcccttccttacatcttatacaaaaattaattcaagatggattaaagacttaaattttagacctaaaaccataaaaaccctagaagaaaacctaggcaataccattgaggccatggcatgggcaaggacttcatgactaaaacacgaaaagcaatggcaacaaaagccaaaattgacaaatgggatctaattaaactaaagagcttctgtatggcaaaagaaactatcatcagagtgaaaggcagcctacagaatgggagaaaatttttgcaatctactcatctgacaaagggctaatatccagaatctacaaagaactcaaacaaatttacaagaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgggataccatctcacaccagttagaatggcaatcattaaaaaaatcaggaaacaacaggtgctggagaggatgtggagaaataggaacgcttttacactgttggtgggactgtaaactagttcaatcattgtggaagacagtgtggcaattcctcaggtatctagaactagaaataccatttgacccagccatcccattactgggcatatactcaaaggattataaatcatgctgctataaagacacatgcacacatatgtttattgtggcactattcacaatagcaaagacttggagccaacccaaatgtccatgaatgatagattggattaagaaaatgtggcacgtatacaccatggaatactatgcagccataaaaaggatgagttcatgtcctttgtagggacgtggatgaagctggaaaccattattctgagcaaattattgcaaggacagaaaacaacaccgcatattctcactcataggtgggaattaaacaacgagaacgcttggacacagggtggggaacatcacgcactggggcctgtcgtggggtggggggagggaggagggatagcattaggagatatacctaatgtaaatgacgagttaacgggtgcagcacatcaacatggcacatgtatacatatgtaacaaacctgcacgttgtgcacatgtaccatagaacttaaagcataataaaaaaaattattagctaggcttggtggtgcgtgcctgtagtcccagctactcaggaggctgaggcaggggaatcgcttgaacccgggtgtcggagattgcactgagccgagaccacgccactgcactccagcctggtaacagagcaagactctgtctcaaaaaaaaaaaaaaaaaaaaaaaagaaagaaaaaagaaatagaaatcagttagcaggattggacaggaagagataaatctttaagtattaatagaccacctacacataaaaatgtatagatgcaatagataaaaattttgttaataagataattgagtattttcagttaagggatcatcttacaaaaatcagtagaattcctctgtattcaaaataattaactagaagagatgatgatacaagatgtcattcacaatagcaaaaacaatcatgtctctaggatctgggaattaacctaacaatgcataagatctacatggaataaattttaaactctgttacagtattattcaaaagacttgaaaaccagatacaccctattcaaagatagtacaacatatttgtaacgatgtcagttctccctaatctataaattctatgaaatgtcaatcaaaatccagtggaatattttgagaaatttgaactattaaataatttatgtggagcttctgattctgattatgacacttttgcttatattacaccagctgttctgctgaaaacaactagaaaaccttgactaaagtataaatttatctgtttgaaggtataagaactatgaaatcagagaggtaaactcccaacattcagccctacctttctctttcaggcagttgccattacctaggcagtagcagaacagctagaaatctcataggcaggaaaaacataacttggagttcaggtttcagtaaagagtagggctctgttaagtatcctaggtattcagtttcgatccttgaaggcctatcacctttaggtgtaaagacaaatggaaacgagtctgccattgtaagacagaaactcagttgcaatcaaatcagttcttaagactccatgacaggataaatatgaaaattacacccagacacataatcagtaaaacttctgaaaaccaaagataaaaaatttgttaatacctagcagaaaaaggacatgtaatttccagaaagcagtaagacagttcacttctaacagaaatgatagaagttgaagataatggaaaaatggcattttaaaactactgaaagaagaaaagccatcaatctaagactttatgcccggcagcagtatctttaaatgaaggcaaaaaccagaagatattgctaaaagaagacctaggcaaacgaaaagacattgcatattcatggatttgaagacaatatttttaagatggcagtattacccaaattgatctacagatacagtgcaatccctataaaaattcaaggtacctttctggtagaaatggacaagctgattttaaaatttatgtagaaatttgagagttccagaatagccaaaacaattttgaaaaagagcaaagttggaggactcacacttcctgatttcaaaacttactacaaagcaatggtaatcaaggttgtgtggtactggcataaggctcatatataaatcaagagaaaagaattgaaagtccataaataaatttttacatttatggactattggtttttgacaagggtgctgaaaccaaggaggtaaaacagttttttttccaacagtgtggggcaactggatatccacatgtgaaagaatgaagttggactctacttcataccatattcaaaaattaactcaatatagatcatagacataaatgtaacagataaaactatgaaactcttagaaggaaacataggtgtaaatttttgtgaccttggcttaggcaatggttcttaaatatgacacgaaatctcaggcatcaaagaaaaaacaaaaaataagatttcatcagagtttaaaacttttgtgcctccaaaaaacaccatcagggaaggaaaaagacaactcacagggtgggagaaaatatttgcaaatcatgtatctgatgagggcccagtgtctgtgttaaaagaactctgcaactcagcaataaaagcacaacctaatttaaaaattgatgagtgatttggatagctgtttctccaaagaagttatacatatggacaatatgtacatgaaaagatgctcaacatcactggtcattagagaaatgcaagtcaaaactacagtgagataccccttctcacccactgagatggctgtaataggcaagacagtaacaagtattgatgaagatatagggaaattggaaagcttatgcattgctggtagaatgtaaaatagtgtaaccactttgtaaagaaattagagagttcctcaaaatgttaaacatagaattaccatatgatccagcaattctactccgagatgtgtacaaacgcaagagaattgaaaatgtaggtacacacaaaaacttgtatatgaatgttcatagcacccttaatcataatagctaggaagtggaaacacttcaaatgtccatcaactgatgaatgcataaacaaaatgtggtatatctgtatgatggaatattatctagccacacaggaatgaagaagtactgatacatgctacaatatgaatgagccttgaaaacatggtgagtgaaagaagtcagaacaaaaagccacatattgtatgattccatttatatgaaatatctgtaggtttgttacataggtaaacgtgctatgatggtttgctgctcctgtcaacccatcacctaggtgattaagctccacatgcattagctgtttatcctgctggtctccctctcccggcctgcccccacctccccaccccataggcctcactgtgtgttgttcccctccctgagtccatgtgttctcatttttcagctcccacttataagtgagaacatgcagtgtttggttttctgttcctgttagccaatagaacaagtagacaagaatcagtaatggataaaggatatgaacaacctcaacataattgacatagaacattatactgaatcactgatgactacttgtttcttgttcagtacacatggaacatttatcatttactagtgtatagacatgcagttgatttttttttaatatggaccttgtatcctgtaactattgtaaatccacttagttttaggacacagtttttgtatatggtcccgtgttagatttccgccttctatcttgtctaacctttatttcctgtctttaccagttttatggtcaccagagggaaaattcaaagtctccaaagtttggcagaaagcatcagagtgaaggccagctatgatgcctggatatccattagtattcttagatgcacttaattttgatgccatgccagtttctttcatctcactcagaaatgtatttaaatggttattttaacagtttctcacatttatgatatataggaaagtaattcaatgtatctgatcttccatactgacagaagttgaagtttttgttttttcatatgaatgttagtctcaacttgtctgcttaaaaaagtgttattttcattgggataatttgaaatttacagatgaaaggagaattgaagtccagtcctctttggattacaatgtgatttataagttcagagaagagagatggccagttttataaactttttacttgtttcttacgttccttactagatttttttagtagctgttgacgggatattttctactatgtttttttctttctttttcttgaaaaatatgaaaggcatttgtttatatatcctacttcattaatattaattacctttgttaccagctaccttaacaaattaccttgtttctagtagtttcctttttgtttattttatacttttttagttatgcaattgtgtcttctaccaaaaataataaaattgggagtctgtacattgagtttccctattagctctcttgactccttgagtttttattttcagctttaactctctatgtaattgctcttacctgtgcattaattttattctgcagtgtagtttctccattttcttttctctccatctaaccctattctgttcatccttagatttcaggaattctttaaaatatctaatcagctgatgttactcttactactttccagtttattatggtttatttttgacaacttatattgtctgtcatctcatgagcttgaaggtgggagggaagtaaatgagtctagtttgccatctcaaaacagactctatttagactatttaaatactaacttaaaaagaaaacatcaacaaaagtcaatgttcctggctcttattcttcagtaactgaatatttcttggctggtcttcgcagctgaggttctttatactgcttcagtgtttctgtcctttgagaacttcaaatctttcctgtttctgcctctacatgtcattgatgaaagtcttcattccttgtaccatagatcctggaagttttgatactttccatctatggactatgatataattgcatcctgtttgagctgtaaggaggtgaggttcaaacctcttctctttgcttctgggttttaactagtatactagagctagatcaggttcaaaattaccggattttctgttaaaagagatcaagacttaaacctggagccaaactggagatttccaattattttctcctaaatgcaaagttgggttctgacttggaatctcggagtagactccaagtatatgtatccagctagctgacttaaggtttccagccagccttacaaaccaattggctagtggaacagagaacagtattgaaatatgggcatccaggccaattgcaagaggacagatcttgagtcctaatccatttgagtttattacaaggacagaagtgaagtgaaagggaattactcatttttgtttttcaacatttgcctcttgaatcaagagagagggtggagcctctcttgcttgtgaggcagggtgtttccacatactcgtaacttgaactctaggaagaaaaaggtagcaggataaattttacagaaaagggaagtagagcagcatgctttgcccaagcactcatctcctttgatacagttccttcagatactttgaaatgactaatgcattatatttaaggccactagtactagtcattgtgttttcaaggaaatcagaggtattccctgcttcactaaatgtatttgtcatgaccaattgcttctttaaaattatcccatatttggaaatcagtgaaagaattgcggcagaaagaaatcagtgaaggaactgaatacaagaataaagtcaggagatgaatgagtttatgaaaatgggaataaagatataaaatacttttattgttctaatggggagatgagaacacctatacaacttcttcctagtatttatacttaacaactattaaattccttatttatgtgtttaatgtttgtgttcaccaataaagtgcaatctctgtgaggccagggagtgaatttctcttatttgttttattccctacttagaacagtgcttttaaatgtaattttttaaatcaagggctaaaaacaggaaaatggagttctttttttctttcatgcttccctcttttgactaatgaaaataatacttattaatcatctactgtaatccagtaatttacatgcccttgagtagggttgcagtttaatcagcaagggggagaggtacacaggattgatacccacttctgtaatttgagggatatttttccaattttatttctattcacaggtaacaaaattgatgtagttttataaacattaatataatgaacttttcttaccaaatatttagtctttttcccatgtattgaaatatttctttgtaaatctgatttcttatggccccaaagaagtccattatgtggatatttgataatttacttaaccatttccttattgttaagctagaatgtgtgctccatgaatataaagattttttttccctctgttagctcattgcagtttcccagtacctacaacagtgtctagtgcgtagtaggtgctcaatatgtatttgtagcatgagtgaaagaatgtgctctattttttccatattataaatgccttataaaacgtttttgtacctaatgctttcactacacttcaaatgattttctaagaataaatttctagaagaggacttgccagttgaaaagacatagaaaaggttgtatgatttcaaattagttttctaatccacaataatgttacctgtggctatttttctttacactttaattttataaattttctataacatattaggattaaaagagttattttttttcttttaagtacatttctatttattcagagagcagtgagcagtcttctaactggaatataaggtttttgttggtggtggtgaaagatgaggcttgaaaggtcacagctgggtgtggtggctacacctctaatcccagcactttgggaggccgaagtgggcgcatcacctgaggtcaggagttcgagaccagcctagccaacatgatgaaaccccatctctactaaacatacaaaattagccggggtggtggcacgcacctgtaatcccagctacttgggaggctgaggcaggagaattgcttgaacctgagaggcagaggttgcagtgagctgagactgcaccattgcactccagcctgggcaacaagagcgaaactccatctcaaaaaaaaaaaaaaaggaagaaacatcacttgggcaaagcagtgaatggcttggtatgctatgctaaggacctttattctgcaggaatcggagtcctataaactattaataagcagaatacaaaaacttcataaaataaataaaaacaaaatacaaaaaagcagagtacagatgccacctgtcttttgaaagtgttatgtcccagtgaacccactgtaaattaaaaataagtcttgaagatgcatttaatatacctaaccatcatagcctacctaccgtagcctagcctaccttaaacgtgctcagaacacttatgttattagcctacagtggggcacaatcatctagcaatactgtacagtgtagagtgtcggttgtttgccctcatgactgcgtgagagctgtggctcgctgcaactgaccagcatcctgaaagagtctcatatggctttctattgaattcatgttgtttttgcaccatctgtaaagttgaaaaattgaaaaatcatcagttgaactattgtaagttggacatcatctgtagtggtatagttagaactcttctagaaaggtaatagtgatagtgctgagcaaggattggttagagaaggggacaaagggaggtgctagatttctcactctctagtctccatatctcaccagtcactgactcagtatttcttcagtttcttcctctttttcttagttagatcctctcacctcaattactgctataactttccaatgtctttccctgccttaaaaccattctccacagagctgctagagtgatctagctaaaactatctgcgcagaatggttcccctgttatctgtatttttaaggttctagtttattaacatgacatacagcttctctgctctttggacccttcagcaccatttcttgctactccctgttgtgctctttatgttcctaggaaaggaagctgcttattgtcctgtgtatcttctcccccacacatatttcctgcctgtgtgccttgcttatgctgtccctacttcccaaactatcccatcctcagtcacatccatttcagtccccttttttctggagttcactgtgtaagactcaggtgtcagccacttcatttaaaaaaacttttaacatacgtattcacatactatacactttcctcctctactcccactttggggtcaaggatctctcttctttactttttataggaccctgatttttatctctcctttccctgtagtactgttatggtactgtctgtgtactactgtttaggtgtgttttgcacaatggactgtgagaatttggggggcaagaacttgtgggggccaagggtccagcccttgttattggtccaacctttggctctctgaaagtttgctgaaaaatgaacatgcacaaggcagattaataggagaaaaggcatacaaatttatttaacatgtatccgcgggaacctgtatgatgaccccaaaatacaggggaaattgcccattcttatacttaggttcaataaagtatagacagctgtgtagaaatgtgattggagaagaaaaagggtatgatctaatgctaacagactgagtggggaaacccagcaaggcctgtgtgtctaaagtcttcttggcctctctgtgcagcattccttccttccaggtatggggcaggaccctctctggaacgggggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaaagtgctgggattacaggcatgagccaccgtgcccagctatttttttaaagacaaggtctcattctgtcacccaggctggagtgcagtggtgcaatcacagctcactgcagtcttgaccaagctcccatctcagcctcccaagtagctgggatcacaggcatgcaccactatccctgactaattaatttttttttttttttttttttttggtagagatagggtcttcctatgttgctctggctggtctcaaactcctgggctcaagtaatcttccctctgcagcctcccaaagtgctgagattataagcatgagccaccatggctggcaataatttctttgtagccagtttttataccaaaaggctgagggaaaactagagtaatatttttaggttttatggctggctttgaggaaagggagttctagtttctgtgacctagagaagagggattctagtttctatggcttaccttgggggagaatgggactgagagacagagcaggagaaggtcaaagaaaaacttctgtgtctaatgcagctgagtccttcattttggagtattgttttctgagcccaacaaactttttattcagctttgtgttctcagcagttagcataatgtatagcatatagtaatgtggtaaaaaaaaaaaaaagcctattatttttctgttgaaataatgaggtcttgaactaggccaggggtagtgggaagggagggtgggtgggagaaacattcaaaaaagtcaactttggatgttagtgataagttaaaggtatgtaatttatagatgatgagatttgcaacttgagtgagtttggtatacagattgttgacttcttaaatttaagacatttgctgaacatgctagagagatgaccagtaggcaactacaaataagggtatagatagtaagagatagggatttaggagttgccagcatattggtattaactgaggctttggaatagataatataagtcaggaaggagaggagatgtaaaaaaggtggagtagagatccttggggaacaatatttaacaggttacagcaaaagaaagattagagaagtatattaattgtcagcagtgtccagtaatgaagaaagggtaaagcagatgagaattgagaacaatttatttggaaattagacagttgttattgaactttgagagaatagtttcagtctagtagagtgaaatagaaattagattgaaataggtgtttgaaagaggttgagaagcaaacaaatgatgagcaagtggaaaaagcaagcatgtactactctttcaaaatgtgctttttggagaaatgtgttgtggaaagggatgtggtatcagttccttgaggaaaaggtaaaatgggggtgacgtttttgttcatatttttgttcttggatggggaatggtcttggaaaagtttttcaattgatatccaggagaaagggggattgaaagcaggaaagaaatttttaatggaataaggacaggaagggaaggaaggagagggtttgggatcaagatgtcaaatgatactgttagccctgaaaagtggtagggttcaaaaggaaaagaggtatgaagcgcaaaaacatttagagttggcatgagggaatgtaaaaggtctgttatctataaagtaggcaaccaggtcattaattgctggtgaagagtagataggacaggaatgggatagtttgtggtggcagggtggcacaggacattttggaagattagtaaagttctgttgagagtgatagaattaatgttaggactgcaggtagatttgagggttcagctgagattgagctatggaaataaaaagcaataataaaaagacaaagtatatatatattcttatatatattattccttacataatatatatttccttatatataaccttattttatatatatccatatatgtatgtgtgtgtgtgtgtgtatatatatatatatatatatatatatataacatgactgtttttcattaaagagactgaagaaaaaaagggatttgaaaaattacttgtagttgctcattaggatatgtaaggcagttacttaaggacagccaaatttgctctactgtcctgatacttggaagaattaaagaatggggtacagggctggggagttggtggcagcagagagcagtccagcagtctgtcaagtcctgcctggtcacaggtcagtgccatttaaacctccaggatcaagtcagagcacttgacgcatgactgataatatttgagatttagtgtgaggtgtctttttaaatttttttttggtgtgttcttgctgtatgtgtgtactgattaaaatatgtaaaataaaagcaacaggttgctggtaattaactctgttatttcaagacagaattgattttgtatagaaaggtagtattggctggattatgagctttactgcttattcattcctgatgaaaatatctctgctgggcttacataccctgtagtgtttatgaactagtaggtttagaaatgaagagaccctagagagataatcatttcctccaagatgttttgtcttctaccaggaatttgtcaatagatatataggcccagtgggtaggctcacctctgcatgaatatttgataggagcatttctatcagttatgctctttcttaaaaaaaaacatgaaaataaacgcatcatttatgtaactcttataagaaatgcataaatcatgggaaacagtgagcaagatataattgaaattcagcagctcagtgagttacgaaccttctctctacaactcaattgtgttagttactgcttaacttaacgctgggttttcctttttgctttcaggaaaacctttaacttacgccctgggtgttgcctgtcaacagtttcctggtggctcaccgcttctgcctgctccagccttgctccggcagcttcaaggcttctgggcttcagagcttgttgtgaaagcttgctgctttggcctgctacccctgcttcaggtgtcaaaagcttttaattagcttgcttcctctaattactataactaggcccttacgtgtctgcataatccagttctagggtctgaaaggagaattacctttagccattcattcttctttaaaagatcttttactttggccctcctggcattcatgggagagtaagaagttatattgcatgattcacctttgatggtgctagtcttcagtctgtaggggcaaactggtgtgggcatactgtattttatagccagtgtttgttctgattggttgatgcccatgctgtcccaattttaaagtattttgactattgctactgaatatataaattgtgtctccatagaaaggatatctctagctggtttaataaactctttgtagtgtttttagtttgcttattaaagataatatttagttccctcccccatttttaataaatattttgaacacaaattggtcgctcacagaacagtttttaaaaatgcagatacagtgatttctatacattttgtaatgatcaccattaacatgtgtcaataggtatcagaattataggtatgatgaatgggaagagctcttcagtacttatataactattcagtacttggagtagtaaagtatactagctctcttatcagacagccaggtacatattctggttctattacttattaattttgtcactatgagtaagttaattaacttctccaaacattagtttactaatttaagtggggattgtagaatctgctttagattggtgtaaggattaaatgaggggtaatatatgtaatatgcttagcccagtgctaggcacagaataagctttttataaataagagttattttttgttattattattaatcataaatgatagtagatgatatgtaggggaaattaaaaggtgaaaaagacaataagtaatgagcagcaacagacaaaagatattaaaggccaagttgtgaagtcaggacttcgatgcctgttaagagagcagagtgagctggaataagctgatagatgtttaataaatcacaaaatacacagttgtatctcttttgtcataataccttatttttgagttttagtgtcagtttagttgtatacttgcagctgagaatattgatgctgtaaactttgcatgtatatacacccacatagattaccagtcattcatcattaattcagctaatgtttattgagtagctatagattcccaattactaggtgtgtactagtgaacaaataggaaaaaaaaatccctgccctcattagcttatattgtagtgaatgaagcaaacaatgaacaaagtacttaaatagaatacatagttcatgaaataatgacaactaatggtaaagggaagcaaagaaatgggttagaaaatgtcaaggggtaaagtgacatttcattgaaggagtgagagagaaagctgtgtggcttcgtggggctagaatattccaggcctagggatcaacaagtgcaaaggctagttgggattgagtgtggtgatcattatagctggagcatagtgaaccagggggagagtagcacgaggtcagggaaggtggagggccagaacatgttggccctataaggcatagtaaggattttgacttttacttggagacagatgggaaaccattggaagctgtggagcagaggagtgtcatgatctgagctacatttcaagaggatcaactgtggctttagtgttgaggatgggttgtgggatgagagggcagaagtagtagagaggtcaggtaggacaatccaggcaagattttcttttttttcttttctttttttttttgagacagagtctcactcacttcagcccgggctgaagtgcagtggcgtgatcttggctcaccacacctccgtctcccgggttcaagcaattctcctgcctcagcctccctagtagctgggactacaggcgcccgccaccacacccagccaatttttgtatttttagtagagatggggtttcattatgttggccagactggtctcgaactcctgacctcaggtgatccacccacctcggcttcccaaagtgctgggattacagacatgagccatgtaatagtagcttggaatgggttggaacagaggagatatggtgaatgaattcttgctatatgcaggaagactagatttatagaactccgtggcaactgtttctgtattctacaacctgtaacttaagaatgaacataaaatactgttacagcattctgtaactgcaatttgtaactagtttgtagcttcaaatgataatacattctgtttaagaactgatttgtatacatttgtcacttagtgattatttctgtagtgtttacagaaataattcttgaattattattacaggttttctaacatcatgtttttactatgaagtctttcaagacattgctagtgtttttaaaaatatatctttgttctgtgttaaactatagtcttgcagttcatactaaatgtacttttaattttgatcaagctaaacaagaaaggacattttaacagactacactgttatatgttaagctgtggttcttgaaaatacaggacctgaggttagagttctaagagaatcctcctcttcttgatttttagctactgaaatgaatatcagtatgacttgcagtgttaaaggagaaaagcaagatcagtttgattttattgtattactttgtaagcctcatattcttttctcatcatttatcaattcaataattcaagaatatttcctgaactgacttttatttcaccacactcaccttattccagaaaagattttaggtagctcatgaaactgttataagataggtttgaaaatgttttccaccctgcagcagcatggcattcctgatgaccacatacatgtgtagtctcattttagccatgatcagttataccacaataccttgataattagcggtcatttcatgaccaggatgtgatgtgtggtatcccatactacctcattccatgcttcaaattttatgtgttttatatagaaaatgtagaaaagcaagtagaaattgcatcacttagaaatacctgatcttttgataaagcatagaaatttatggtacatattttatgtgtgtgtgtgtgtatatatatatagagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtcataagtctaaaattacagaaagttagaaattaaagagatgaaagatttttttattttggtagttaaactgaagaaattgagagttatattctttgccacatattagaggtagagttggcagtgaagagattgggctgtaatgtgcttagtgcaatgcctggcacataatcatagctaacacttattgaatgcttactaagcaccagacccttgaaaaacttgaaattatttttcaccctgtggcagcatggcatccctgatgactgcacaggtgtgtagaatgggtctcattttgtccctgatcagttacaccacaatacctcaatagttagtggtcaataatcccgagtacaaggattatacttgtattaatttttcaaatctttaccacaatgatataagtattgttattaaccccatgatcatgacaaggacactgaagtattgaaaggttaagttttttgcctagagttatacagctaaggacaaaactaggattcaaacccaagtagtctggcttcagaatccatgctatcaccactccccaaaacagccacaataaatgctagctaagtgtttgagtgttcaataaatattaggcgtcatcattattcctactgcacagttgcatattccagaggtggttttggttccaatatttttggattttagaaagataatttagtttgtatactctattttatgtaacattctcattggggtttggagcagcccttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactcctccttctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctatccatgtgcactcccagttgtgcagggtttgattttagagtctaagcaatagctcacgtggtgtgttcaccgcttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaccacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccaacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgagaaagggattttatttattgtatttgatagtttttgatctgcaattgaaatataaaatacagaaatagatgttcctttttttttctttttggaagggatgtgtaaagtttagtttttgtaaaatcgttagttttaattgctctctatgcgtatgtatatgtgtgtatgtggtttgggggttatggtatagtatgtaagagtatgtgatatgaaaaataggatcgttttcagtttatttcatattgtttgatcctcacaaaacatatttgttttggcagctggccttccttgtaacatggtgttggaattttgcatgcattatttaataagctctagttctttcctgttgagcattttgttcagtttcttagtgatagtagatattgagtttgaattccagggcagaaaagttggaaagggggattaatgtgtaattaccaactaatacagtgttcaaaaataccaactaatacagcgttcacaaataccaactaatacagcattcacaaatacagttattagtttggcacatgttcactaactttttcatctggcaacattatttaatttaggatcttagaatttgaactgcattgacataattgataattggtatttatttttttacagaggaaaaaggaaaatggatggctgaaaaaattatttgtcattattttaaaatttatatttcctttatcttttctaggttgctgtagtaaaactaaaaaatgcagataaagtgtttgccatgaaaatattgaataaatgggaaatgctgaaaagagctgaggtaagagtcttatgtattggaatatataaatattttagaaatatttttcaggaattataaaattccatagagctcattaaatattacttggtaacattttgtctgtggtgacattttttaaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgattatgcagtcactttgtattttgttttatattacaggagttgtagtaaaatctagtaatggaagaactgcctgcatttttatgtagatttgagggaaggattgactggagtgatgttaaaaatatccagcagctggtatggcctggtcagaactgctgtcacacatagatttggagtggacttctggggggtccgctgctgtgctgtatcatggtgaagggttgaatgggataggcattctggggcttcagggaagcagaacttaactggtgtagaattctgtcagtattttaactggtaaaaggtgatactgacgagcaggctgagtaatagccctggaagttagtaagattagtaagaaaataatgacaaattcgcctttagaaatctttatctgtcagtacttgtagcaacccaaagatgaacaaacatacagggaaaagcaaaaagtgtttccatgatgacagatatggtggcagtgaaagtaaatacttcattatttatttatttggagaaatttgaaaacacaaagaagaaactaataatcacttttgttctgttacccagaactaataacattttggccaagtttttgcttttagtttttttttttaaactaaaaaaaacaaacaaacaaaaaccctcagaagtgaagcacaaatatattctctgtaaaacaaataatagcatattacagataaagccaaagtgttctttcaccacccaagtccatcctttctctaactcccagaggtcattattacttttaaaatactatttcttcattaaacattttttttgtttttatatatttaggagatacaggtgcagattgctgacatgcatatattgcattgtggtgaaatacccatctagtgaacccatcacccaaatagtgaacattggacccaataggcaacttgtcagccctcacccccttcccaccctcccaccttttgtagtctgcaatgtattattccactctgtatgtccatgtgtactcatggtttagcttccacttataaatgagaacatgtggtatttggctttctgagtttttttcacttgggataatgatctccagttccattcatcttgctgcagaagataagatttcatatatttatttatgtgtatatgtacacacatatatacatacatacatacatatatgtatacacacatcacattttcttcagtcctgcgttaatggacagcaagattgagtctgtgactttgctattgggaatagtgctgtgataaacatataagtacaggtatctttttgatataatgattttttttcctttgggtagatacctagtagtgggattgctggatggaatggtagttctgagaaatcgacgtactgttttccataaagattatactaatttacattcctactaatagtgtataattgttcctttttatctgcatccccccagaggtaattattgtatagtaatatcctgtttgacaaagtatctgggagctttaatgtcacatgtatcactgggatatgtgccagtgtccattatattcaacaccttagtttttacttttaatttccctaagactgaattgccttactgtcactggttggatttctcaaggagtaaataccgagattgagtttattgtgcagatatttgtttgggatttcttttgagaaatccctacctgtagaagggaagggagggagataggatttgtaaagttgtcccatcagcctcagttgattccactgggagctctgtagcagaaatggctcttgagaagtgtcctacattggatcaaaatgtctagacctttatacacctgcctctactagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcagagttagaacttttaaaaaattgaattaaagtttatacttttttcaatgaagctggatatgttggggaagaattgtgaaaaggatgaataactgggttagctttcattacagctggaagtggcaaaattcaaaataaaacagtataatttaaaatcaaatattttattcaattaacaagtatttatatattctgtttctgagacaagatggaatagactcacttctccctgttctcctgtgaagtatagctgaagattctggacatttatatataaagcaaacattagaagaacccaaaaggtagagagaataaggtagaccagctagggacctcaggaccttacggtataagacccattttggaggtcagtattatgctgatagaaaaacctgacaaggaccatacaaagaaagtttaagataaatagtcctcgaaataccatttgacccagtcatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtgtgacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggccagagacacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacgcaaatcaatcaatgtaatccagcatgtaaacagagccaaagacaaaaaccacatgattatctcaatagatgcagaaaaagcctttgacaaaattcaacaacccttcatgctaaaaactctcaataaattgggtattgatgggacgtatttcaaaataataagagctatctatgacaaacccacagccaatatcatactgaatgggcaaaagctggaagcattccctttgaaaactggcacaagacagggatgccctctctcaccactcctattcaacatagtgttggaagttctggccagggcaattaggcaggagaagaaaataaagggtattcaattaggaaaagaggaagtcaaattgtccctgtttgcagacgacatgattatatatctagaaaaccccattgtctcagctcaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacttaggaatccaacttacaagggaagtgaaggacctcttcaaggagaactacaaaccactgctcaaggaaataaaagagtatacaaacaaatggaagaacattccatgctcatgggtaggaagaatcaatatcgtgaaaatggccatactgcccatggtaatttacagattcaatgccatccccataaagctaccaatgactttcttcacagaattggaaaaaactactttaaagttcatatggaaccgaaaaagagcccgcatcgccgaggcaatcctaagccaaaagaacaaagctggaggcatcacactgcctgacttcaaactatactacaaggctacagtaaccaaaacagcatggtactggtaccaaaacagagatatagatcagtggaacagaacagagccctcagaaataatgccacatatctacaactatctgatctttgacaaacctgagaaaaacaagcaatggggaaaggattccctatttaataaatggtgctgggaaaactggctagccatatgtagaaagttgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaacatttttgcaacctactcaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcgtcatcactggccatcagagaaacgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggattaagaaaatgtggcacatatacaccatggaatactatgcagccataaaaaatgatgagttcatgtcctttgtagggacatagatgaaattggaaatcatcattcttagtaaactatcgcaagaacaaaaaaccaaacaccgcatattcttactcattggtgggacttgaacagtgagatcacagggacacaggaaggggaatatcacattctggggactgtggtggggtggggggaggggggagggatagcattggagatatacctaatgctagatgacgatttagtgggtgcagcgcaccagcatggcacatgtatacatatgtaactaacctgcacaatgtgcacatgtaccctaaaacttaaagtataataaaaaaaaaagaaaaagaaaaaaaaagatgaaaaaaagatatgccagtaaaaaaagaaaaaaaaaatgtgtgacatatacaccatggaattactatgcagccataaaaagtgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccgggggactgttgtggggtggggggaggggggagggatagcattaggagatatacctaatgctaaatgacgagttaatgggtgcagcacaccaacatggcacatgtatacatgtgtaacaaacctgcacattgtgcacatgtaccctaaaacttaaagtataataataataaaataaaataataaaaaagataagtagtccccatgcatatagatgcaaatatccttaacaaaatattagcaaatacaatttagcaatatgttaaaagaattatataccatgcccaagtgtgatttattgttgggatgcaagactgattccatatttgaaaggtactctcctcaaactatttgagaaaacttttatcttttagacagaaattctgcattgaaacttttaaggaagaattcactttaaaatagaaattgtatttctattcttgaataagcagatctttttaaaaacaaaaacatttctaaaaatccttctgaccatgacttatccaactttggaaaacaagacctaccagtgatgcttaataaattacaaatgagcagcaaaattccttattttttatttgtgtattgttgatgctttaaaacaattttttcagaggtttatgtacaacttatttaccttattctgtttcaagccatatgtcaaatatataattaatgatatacgggttactcaaaggtgctaggaagcctcctctcttttctatacctgggcagaaaggtataataatataataattgtccaataatttcacagatttatcatttacaaactttgctagtttatcaccaataactctacaagttcatcatttacagactttgctagtttatcaacagcctcctaaattaacaaatgaactactgctctcaatctgttctgtaaattttacttctgtcttcacatttgttcagtgagtactgacttcgctcattaacagatgtccttactcatttcatgaggagatgcggtatagtttacagaaacactcactgtcttgagagttaaacctttttataaaaccttttaaaaacattttatttattgaggcagagtcttgctctgttgtccaggctggagtgcagtgttaggatcttggctcactgcaacctctgcctcctgggctcaagggatcctcccaccttagcctgggagtagctgggactacaggcacatgccaccacactcagctaatttttgtattttctttagagatggggtctcactatattgctcaggctagtctcaaactcctaggctcaagtgatctgcctgcctcagcctcccatagtgctgggattacaggtgtgagccactgcactgggctgagagttaaacctttctaaggctcaattttctcatgtataaactgaagataataaggtctcataagtagggtaacagtatatcttagtttatctgtgacagtgctgatttatgcctattgttttattagtttttctattgttgttatccttgtttggctatttttataattgttagtaaagtactacacaaagtaaaaaatgaacaaatgcaagttcccttttctccctcaaatacccctagtccttctgtcttaagtagatcattagtaagggtttcttatttatcctcaacagaaaattttattataatgaaatcatattacaaggctgatttttcatattgctttttcactaaaatatgtattgttttttcacttctatgtatttaatacatttataatatctcattctttgttaatagcttcattatactgaatggctctctgtgtgtgtgtgtgtgtatatatatatatatattttttttttttttttgagacagagtctcactctgttgcctaggctggagtgcagtggctagatcttggctcactgcagcctcctccttcagggttcaagtgattctcctgcctcaccctcccaagtagctggctgagtacctcccaagtacctcccaccaccacacccggctaatttttgtatttttagtagagacagagttttgccatgttggccaggctggtcttgaactcctaacctcaggtgatccatctgcctcagccccccacagtgctgggattacaggcgcgagccactgtgcccggcctgaatggctatattttttattaggttgattttttttttaagtttatgggaatttagattgtttccttatttttactattttgaaccatgttgtaaaaatctttatatatactggataaacttttgtgagtttatcggtagtgtgaattcttacaaagatgaagtgtcaaactgtcaatacatttcattattttaccatttatctatctgcatgtgtttggccaagagaaatttcaaaacaggagagaaactagtgcttcaaaactagtcatgctacccaaaaagtatatgccatgtaaaatttaaaaaaattttactatgaaatgctgttagagatattggtgtgggctaccctgaggcacttcagcttgtgtatactgaagttgaaatgatttcaaggataatttttacatgaagggattatcattttatgcttgacctagaacttatccactccctaaattaaactccttgctagtcaaactctgggattttagttggggaggggagacattaaaactttgatagctattgttccaataaaattatcttctataaaagttggactattatctttgcactcatagtatgtaaacatgtctgttttctcacacacttggcagttgtggatgttaccaaattatttctatatttaaaattacatttaaaactttttactgaaaaataagttaaaaatgatacatctcatgtttgatttggccatgaaatatatattaaaacgaagacttaaaagtgaattgatgccatggtaatacttggaattcttacattttgcaatttaaactttcactgatttagattttaaaaatgaaaaatgttgttctttccctcaaatattagagaaagattcagttattatttgaaagagtttctctgtgatagtattctatggaagagtgaagtctttattcctactaaatgataagccaaagtagatataatcatcagtggattttgtttctttttaactcatgctttccaagtatctgtgcagttttgatgagcagtataagcttgttagtctgatgagtgcatcttatcaatacgatgaagagaatcctgtgtcaactttccagaattaccatttatgtatgtagtccttactaacttgtgtttcaacataggcattcctgttcctgtttatcccaatagtccattaaggataaaatttaaataatatagactgaatattttttaaaaaggaaaactgtataacagttgaaaacatcactgtggcaagccgaatgtttggatgaacatttggttgagaaagtgagtgaatccgaggaagtgatatgatctacagtagcccttcctacatgtttgttattaatacattcttagatatcaaatattctgtttttaaaggggggagatattgtttagttttttttaaaaaaggtaatgaagtagatgttactaaagcctttaagcatgttgaatccacagagcacctttatgaatatatatatacccagggtatatgtgcatcatgatttggttaatattgatctagaacagggcttctcaacagggacttcattgacaactggggccagataatgctttgttggaggggttgtcgtgtgcattgtagaatatttagcagtatccctggcctctacccactaaatgccagtagaacccatcctttcccaattgtgacaagcaactgagagcagtgtgatatgttgaagcaaaaacgtagcctgtgctttatatctagactcaggattcaaggcattgataggaatcatttaatagctagatatttatggataaaatcatatgctgtctggggtttgcttaaaaatatgtatatgctcctgtgtgtgtggtgctaggggatggtagtaagtaggtgagggtctaaatgaaataagattgaccaagaaaataattgttgaagttgagttcattagtaggagggggtttttatactagtttctctacccttgtatacgtttgaaattttgtatcataaagagtttatattgtttattttcttattttaattaatgtttttgaagagacagtcttgctctgtggcccaggttagagtgcgatggtgtgatcagagctcacttcagcctcaaactcctaggctcatgtgatctttctgcctcagccttccaagtagctaggactacagaggtgcatgccaccagcctggctgattttttttttttttttttttgcctgtagagacagggtcttgctatgtcaggcaggctggtttcaaacttcaggcctcaagcgatcctctcacctcacttcccaaagcatgggactgcagatatgagccactactcctggcctattatttttatttttaaaaaataatttttttagttaaacagtttagcatagattagaactcaaagtttaatatgttctgttgactaaagtctttggagctttttttagttttgagttattagtcaaattaaataacgaatgtttattaaattctaactagaatgtttgtaaaatttcggattgctattatagtgagatgaagccaggagaaagtagtcttctaggctctgacagtctttacaaactctctaatatgttagcagtaaaccataacctcaggttggttaaatcataaaacaggacttggtagtaagtatgtaaagtgctttctgttttccccttaaaaagaaccagagcggccgggtgtggtggctcacgcctgtaatcccagctctttggaaggccgaggtgggcggatcacgaggtcaggagatcgagaccatcctggctaacacagtgaaaccccatctctactaaaaatacaaaaaattagctgggcctggtggcactcacctgtagtcccagctactcaggaggctaaggcaggagaattgctcacacccggaggcagaggttgcagtgagctgagatcacgccactgcactccagcctgggcgacagagcgagaaaaaagaaccaaagcatagtgttgtatagattttagtaatttaattgttttgtggatcatggctgttgaattttccttgtgggaaataataatcacttattatatatagcatactgtgtgataatgtttttagtgtatctggaatatggtgtagccattaagaaaaaattaggtagatttctgtgtactgatacggaaggatgttcaaattcattgttacttgaaaaaaaaaaaaacttacagagcactataatctcatttgtataaagaccaaaaaatataggggaggtgggataccatgtgaatatataatctgtgtgtgtgtgtgtgtgtgtgcacgtgcacatgcatgcttatatagacacagattttctgagaggattttgaccaaagagttaataatggtaacctctgcacacaacaattgggcaatgaaactatgggaacatgactcagggagacttttactttcttagagttatctttgaagtttctgtcatagtgttatttttgtttctttttagttaatgtattacaaaattatgatacataaaattgatttttaggctgggtgtggtagctcatgcctgtagtcctagcactttgagggggctggaagattgcttgagcccagtagtatgagaccaacctgagcaagatagtgagacctcgtctctagaaagagataaaaaaaattagctgggcatagtggtgtgcacctgtagtcccagctactcgagaggctaaggtgggaggatcacttgagcccaggagcctgggctgcagtgagctgtgattgtaccactgtactccagcttgggcaatagagtgagatcctgtctcaaaaaaaaaggttaaacaattatttttttatttttgttcatatatttctaaggttcttcgggatatacttttatagtagtggaagtgtattctcagaataaactacaactttaaaaaatcaatttgaaaaaacaatccattagagaaaatggacaagggaagtgaacaattaaaagacaaagttcaggtgtccagtaagtgtatataaagctatttatctgcacctgtaattaggaatatgttaattaaaggaataatgatattatttcacacccgtcatgttggcaaccacttaaaagtctaataatgtcacatatagttgaggatgtggggaaaagcagagctttcatattctgggtggagatagtaattggtatagcactcaggaaagacaattggctaaatggtggagttgaaattttcatttagcatttctacttctaagtgtatacagtggagaaactcttgcacatttgtacaaatatgtttattccaacattgtataataataatacaaaactggaaataacctgtgtttccaccgttgggggttgcataaataaattatagtgcattcaaacaatggtatgccatagcagttaaaagaagaacagtcattcttgagaaaaaaaaaaaatcaaattgcaaaaggataaaattataccattcacatagattttttttgtttttgttttctttctttctttcgtttttttttttgttgttgtttttttttttaaggcaaggtctcactctgtcacccaggttggagtgcagtggtgcaatcttggcccactgcaacctgtgcctcctgggttcaagcaattctcccgtcttagcctcctgagtggctgggattacaggtgtatgccaccacaccctgttaatttttgtatttttgttagagacagggtttcaccatgttgcccaggctggtcttgaactcctgtgttcaagcaatctgcccacctcggcatcacagagtactgggattataggcgtgagccactgcgcccggcccatgaaaattttcaaaacacaaaacaaatctgttgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatgtcttataatatcaggtgtattccttttccagaacagaaataatataataaacatagtaattctttgtatatttcctagttttacataaagtatgctctaaaaattttctttttgcgtttcagacagcatgttttcgtgaagaaagggatgtattagtgaatggagacaataaatggattacaaccttgcactatgctttccaggatgacaataacttagtaagaatcatttttgtatttctatatactgtttttttgttggaagaattagcattatttttatttaagcattgtttaaatgtaggtttcatatagaaaattaagtgcatttcacacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagtttttcatgatacctttaacaccagtaccattcctcttcccttgttcctgttgaagtccagctagtactttaaaattgtgctcaaattcatcttaaaataatcatttccagaattttccactgaaattaatctttctcatctcattctaactttacatttttaaattatttttattacataactaacacatgtatctctgattttttttgatacaactttaagaaacatttaaataggccggatgcggtggctcacgcctgtaatcccagcactttgggaggccaaggcgggaggatcatgaggttaggagattgagaccatcctagctaacacggtgaaaccccgtctctactaaaaatacaaaaaaattagccgggcatggtggtgggcacctgtagtcccagctactcgggaggctgaggcaggagaatagcctgaacctgggaggcagagcttgcagtgataatgccactgcactccagcctgggtgacagagcaagactcggtctcaaaaaaaaaaaaacacatttaaatatgttacatggactgtaccatctttacctaaaataaaattaaaggtttttccaaccccactggaaacaaggaaaaaaaataaaggtttatgcaactctataatgctcatggggtttatctgatttcaggccagatctaggtgttcaaacagtgtcattactagtcttttatatcccttacatgcttatagagtataataatgtttttttaaactacagattgtgacccattagtgggtaataaaatcaagttagttacaagcaacattttttttctttctttctttctttcttttcttttttttttttttgtttgctggatcttgctctgttgcccaattagagctaactgctgtatctgattcctgggctcaagcagccctcccacctcagcctcttgagtaactgggactacaggtgtgtgccactgtgccccactaacttaatttttttgttgttgttgttaagatggggtctcagtttgttgctcaggctcgtcttgaactcttggcttcaagtgatcctctcagcttgaccccctaaggtgtgtggattacaggcatgagccaccatgcccagccataaggaacatttttaaagattaaatagaatagaaaatgacagagttcatgacaagtaagtagtaagagtgaatatggtctcatgacacatttcttttataatatactgaattatcatataagccatatatattattgtgggttatagtgagaattgtgtaaaaaccatagcatagagttttttgtatgtgctagatgcatagttgttaaattgaatagaatgatgttttaactggatttattatacttaatatacaaaattttagggatgaatgtatcatgcaaagataatctgcatgggtttgttaacaacatttgtaagagcaaattaaaacacatcccacatctttgcctagaaaaattatagcaatgtatcatgataattttcaaaatgttttcaaataatgaataaaatccactatgacggtgtattctgtaatagataaatttaacactgcagatttgtgcattgcttaaaaatctacattttggtataaatatagaaataattatataattttgtaggtatattaatagaaataaagtacccaaataccaaattttatatagcaaaaaaagcctgaactgtgatttatctctctcctcttgtttagttttatttgcattcttcgtatttgacattaggattaacatttctttttcaaagacatttttcagggaaaaatagtctgtatatacccctcaataattactaaaatagaattaaagacgtaactggaggaggaatgaaacactctagtagtcaaatctcctgtaacttgccagtgtttctttaggggagccttcatcatatattcattcatctcaagagtcagaggtcttggttatcatcaaaggttgccttttgaacatttatacaatattagaaaaaatcattaaaaaatgtcgacaaagctaattttagataccaaaaaaggaaattttattatatataattgtttttcaaagtaacttttaaccctgatagcttttaaattgccaagtaaagaacataatttataatgctatacggttctagaaagctgtggcaaataactttcatttctaacctacttactacaatagtttatgaaaaaatttgcaattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaatatcttgcactgacatatgtaacttgtttaaaaggtgaaagatacttgaattttaaattaattgtagtaactcatatgaactctaaattctttataggaatccaatttgtgaagacagaaattattagaaaagtaatttttttaagaaaagtattgtttagggccgggcacggtggctcatgcctgtaatcccagcactttgggaggccaaggcgggcggatcatgaggtcaggagatcgagaccatcctggctaacacggtgaaacccggtctctactaaaaatacaaaaaactagccgggtgtggtggtgggcgcctgtagtcccaggtactggggaggctgaggcaggaggatggcctgaaccctggaggcggagcttgcagtgagctgaggtcacgccactgcactccagcctgggcaacagagggagactctgtctcaaaaaaaaaaaaaaaaaaaaaaaagtattgtttaatagtaaaaagaaagcaaggaggattaactataaggtgaggctctaaagattgactgttaatctctttgttatggcagcatgagaattaaaagagtttcctgatattcctacgaagacttctagaattatatctgttccttgaaatgctcattttgggacacataactcatttattgcatgttttcagatgttttagcattgtttccttggactggagctctttaaaaaaaaaaatccccaaagctgccatggtctttttagtaatttaaccagtgattcctcaaatcaatgattgttgctttggctttcatttccctagtgactattgaggttcagcatgtattaattggctgattgtgttcccgcttatgtgaattatctgttaatattcttagcctagttttgttggattgtttgtccctctcttaacaatcggaaggggctctttattttaggattatatccttgacctattatgaatattacctctcagtctatgttttttaaaaacttgtataaatataccttagctacattgggtaatattttaaaagtagtttgtgattaggagtaccaaatattcaattttactataaaattaaccaatcagaacaatatgatattataataatataggaataggtaaccatagcagaatagattaggaacagatataagtatatttgggatcttaaaatatgacgaagggacatttcatttgaattgaggagaaagaatggattatttaactgttactttagacttttagtcttatagactctgtctataagaaaatagtcttcacactttaatcaaaagtaaattgtcaggatagggtcagttcaacgttagggtaccccgacgtggtggctcacgcctgtaatcccagcactttgggacgcccaggtcaggagatcaagaccatcctgggcaacgtggtgaaaccccgtctctactaaaaatacaaaaattagctgggtgtggtggtgcgtgcctgtaatcccagctacttgggaggctgaggcatgagaatcacttgaacccaggaggcaggggttgcagtgaaccaagattgcgccactgcactccagcctggcgacagagcaagactctgtctcaaaacaaacaaacaaacaaaaacgttgggcctagtaaatacagcaagtaggccaaagacacaggattttaaatatattctgcttccctaattttcaaggctttaaatatgcgaaattagtttctttggtttaacacacatttcctatgtttgtaattttaacatatagtaataaaaggaatttgaattttttcaagactctttaaatcttaatgtcaactcagtaatatccctgaaaacaatatcttcattctgtaataaaaccttaatttcaaggcatttatgtgtcttgtactcactagccttcatgctaagtgctacattatcattattgtagttaggtagatgagaaaatgaaatgtcacagagattaatttttcaacgtccacttacaacatggagtcagtatttgaatacaggtttctctgactacaaaacccatttttccactatgtctagttttctccctcacttaaaaataatatataatgtacacacaaatacacatgtatatgtaatacatgcttataaagcaatgtagaacataaagttataacatcagctgtaatctaacaacctacagaatctcagtgaacagtttgatgtactcttctcatcgtttctttacaccacatacatacccataaggatccatatctaaaattagttggcttctgtttattatatacacctgagaaaagcccattctgatatttttacagtattagaaatgggaagagacacatatggtgataattactatattctacgtagtagtggtttctaaatgctgatctataggctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgcctcagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtcaacaaaaaaaaattattttgagatgattttggttgttttgctttgttgttattattatttgtcagcattacagaaccgatgtgcctgcttatacatacatgtacatgtatagtatctaaaagttgtcactcctagaataatagacattggagactaggaaaggtgggaggaggtgagggatgagaaattacctatgggtacagggtacactattcaagtgatgggtacactatattgcataactcacaaccacacaatatgtccatgtaacaaagctgcacttgtaccccctaaatctatgaaaaaaaaagttctcggccggtcacggttgctcacgcttgtaatcccagcactttgggaggtcaaggcgggcagattacgaggtcaggagatcgagaccacggtgaaactccgtctctactaaaaatacaaaaaaaattagccgggcgtggtggcgggcacctgtagtcccagctactcggagaggctgaggcaggataatggcgtgaacgtgggaggcggagcttgcagtgagccgagatcccgccactgcactccagcctgggtgacagagcgagactctgtctacaaaaaaaaaaaaaaaaaaaaaagttctcacttacagtcagcatttctagaaatcacttcttaaaaaaccactcttgtttaaatgtacatatgaattccatctcaaaaggagtatgcattggtcagtttccttatagttgagtcttacatatttaaattagctggaattctagaccataagtcataggttcatttgctaaataagtcctgtattatatattttatgtttctcaagaaaatactttcaaggattgtatgtgccaaaagagatttttttttgtatgaaagtgataattttaatgttcatggagtaattgtaaactattaatactttatatttaaaaattttaaaaataccagcatgaatttggaaggacacacaaaaaataagaaataaattaaggatatattggatgatttaaaaggtaccctcacattttaagaggaaagtaggaaacagcagaacgttgttggtgaattaatcattcaaatgagagtatctttggatggtgcaaaatgtgagaaagagaaagatgctgaggagaagtacgtaaagggatactgccaagttagaaataaactaaaccattttctaagagtgattttcaaactttggcatgcatctgaatcctatggaggaagggtggttgaaacccagattgttgagtcagctgcagaagtgctgattcagtgggttgggtcgggctggggaattgccatctctaacaagttgccaggtggtgatgctgctgctggtgtagtgaccacactctgagaactatgctctaagacagcagtgactgtttcttttaagttttgggtggtgagagtgatctctgagaagaacatgaatgtggcaaggagtagaatgtttctgtttcagtgtttgctttttaagatgtgggtgtcttaattgctgtttcatttaattagtattgaagttctaagacattattaaaggaagactactttaattaaacaatttgtattttatcagatctctgtttggcttttgcctattcgtgtgcttttctctgtgggtatctgattgtcacagtttttattgaaaataaagatatggaaatgctttgaaaattgtacaatgcagtttttttttttttaatttaaatttttgtagagatgggggtctcactgtgttgctcaggctggtcttgaactcctggactcaagtgatcctgccacctcagcctcccaaagtgttgggattacaggcatagctaccacttcttgccacagtgcagccttaaagatggtattgtggtctcaagagtcagttatagaatgagaaacgaaagtgctattttgtggcttaaacagtaatccaaaatcctagctgaggactatcatttaaaaatacttacagaaaatactatttcgttgaatatttgaagaatgttactaaacatagagtcttaggcttgtggaattgagagatttcacccagtttatatgtaattcttgagaaggaataactgcttctgaaaattatatgcctagattggtgaaagtaaatatgaggtatttgtagtatctttcattctgccaggcttgttagagatactgttatgtggactgaaaaccatttcaaccttgagctctgcttaagtacatctaattttacaaggtacttttaaatgaatcgtatttattccattgttgggcagctctaatattataaaattttattttatattaagctgaatttcttctcttctcttttttttgagacagagttttgctcttgttgcccaagctggagtgccgtggtgcgatcttggctcactgcagcctccgcctcctgggttcaagcgattcttctgcctcagcctcctgagtagctgggattacagtcatgcgccatgaagcctggctaattttttgtgcttttagtagaggtgggttttctccatgttggtcgggttggtctcgaactccctacctcaggtgatcttcccgcctcagcctctgaaagtgctgggattacaggcatgagccaccgtgcccggccttgaatttctttttattttagtcattggttctagttttgcttttagagtcacatataatttatttctcttctagttatcatgctttctgaagtcttctttaggttgaacatctaaacatctctagtttctctgttataacaatttgtatacacttcctaccttccttgtcttaaccccccaccacacactctgcccattcctacacctcttctccctccctccttttctctacttttacctttctgtggatgctccattgtgttaatgtgctccttaaaatgttattctcattttctggatagactattttcagcaaatgctttactgaggaaatattttttgagtcctcttttataagtaacattgtgctaaactatgtggaattgtaagtaagtgggtatagcatatagttgtggcttttgaaaaggtttcagttgtttggaggcacaaaacctaagatagaaataaaacttaaaataccacaagttaaatcatttaaggccaaagtataagagatgatggagtgagtccagactgtggattgctaaatgagttatacaagcaaattacagtgagctcaagaaatgagtaataagtttatttctaatgatcagttctaatccttatttaactctttgtactattcactgtattctaacacaaattctgtgatttagatgtcatctaaaatcgacgttgccccattttatagatgaggaaacccagcttcagagacattagttagtaagtagcatagcctagattaaaatctaagtcaggcttgtctccagatttatgttctttgcacaacatcatgttttccatagaagactttaatggcggggctttgaaggatgagaagactctgtaggcagataggaagacattcaagataggtgaatggtaggagaaaagcacataagaaggtaaatagtagttttggaaaatacttaatagactagtttggctagagaaaagagttcatgttgagtttagtaggagattaatttgtaaagagattttggttcttatcatggaactcttgaatgtcacagactttgtatcttggtagctaataaactacaatgaatttcaggcaatgaaatttgaaggtaaacttcatgtcttagagttttatgaaatttatcaaatttccaaatgtgttataattcatgaacttaaaatatagggatgtggagaatacaagaagggactagtgagactgttgtgtttaaggaaggagatactctcctttttcttgtgttctttttaaggaaatatatttctagacttgtaaaagtatgttgtttgtcttctatcagcacaaaaactcgcatatgaaaaaatttgcacaaaggtttaacaagagcaatggaaaatagcaaatggtacgaataattaaagtaaaatattttctaataacattgagtagccaaaaagcactggactaggaatcagaagatttaattccatcacctatcagattccccatgtgttaaaggaggataataaataatgtttactctgcttgttttgccagactattgggaaggtgagatgaaatgtgtatatgaaagtgttttgacagtatagacaatatgccattgcaattagggaaacatctttttgcattataaatttgaggcattaaaattattataaataagatagtttcatcctttggttctataattctaaatacatttttctgtctaggtctattgagaatatttcttactcttacttagttttcatttctgattttcccttcctttctttgggcagtatttttcataagcttttgtgtgtgctaaattttatttaagaaatgcaggggtataagcatatatttctaaatttgcttgcatttcctaaggaaagttttacaactgggatacaccggcagttgtaaaaatggttgcctaaagagagtagggtggagagaaagtgggatggacagggataggaatgaaagctcaatttctaagtgaatacccttttcatatatactttttaaatcagtaaacttccttatttagagcagttttaggatcttagaaaaattgagtggaaagtatagagttccccttatatctactcccgcccaccacacacacacacgcacagcctcccccactatcaacatgccttaccagagtgtggcacatttgttaacatcaatgacccttcattatcacctaagtccatagtttacatgtttacattcgtgttctctgttggtgttgtacgttctgtaggctttgacaaatgcagaacaacgtgtatccgccataatagtattatgcggaataatttcactgccctaaaaatgctctgtgttccacctctttattcctcccttcccgctaacccctggacatgactgatctttttactgtctcataggtttgccttttccagaatatcatatagttggaatcgtacagtttatagacttttcagattggcttctctcgcttagcaatatttaaggtttgatagctcatttctttttagtgagtaacattctattgtcggcatgtaccatagttttccatttacctacttaaggacatcttggttgcttctaagttttgggaattgtgaatgaagctgcattttatatgattgcttttttttttccctctctctctttttagcatttcaattatacttctattttttaacttttcttaatggttaccctagagtttgcaatataaatttacaactaatctcagcccactttgaaatgacatggtactgcttcataggtagtgaagtaccttgtaataacagaataatcctaattccttgttcttgtcccttgtatcattgctgtcatttatttcatgcataagtaataattcatatttgagtacattgttggcattcttttgatcaaactgttatcttttagactaattaaaaataaaaggtaaaagtttttattttaccttcacttattcattctctgatgctgttcctctctttacatagttctgtttctgatttgtatcatttttcttctttttgaagaacttttcaatttttcctgaaatatagttttcctggcaacaaatcccctcagtttttgtttgtctgagaatgtatttctctttcacttttgaaggataattctgcagtatatgaaatcataggttggtgaggctttttttttcttttaaatatttcacttcactctcttcttacttgcatgatttttaaggaatcagatataattcttatctttgttcctctatgcataaggtgtttttttcctctggcttctttcagggtttttttctttatttttttatattctgtagtttgaaaatggtgtgcctaggtatagttttttttttttggggggggcgggtgggggggtgccatttatccttcttgatattttttgaatttcctggctctgtggtttgatgtaggaaaattttggggaattatcagacattattgcttcattccatttccttctggtattcccattacatgtaacttataccttttgtagtaatcccacagttcttggatattctgttctgttttttttttttccagtcttctctttgcttttttcattttgaagtttctattatattctcaagctcagagattcttttctaagtggtgtctagtctactaatgagctcatcaaaaatattatttatttctgttagtgtttttgatctctagcatttctgattctttcttagactttccatcttatttatctgttcttgagtgttgcctactttaaccataaaatctttaacatattaataatagtttttaaaattcctggtctgataattgcaacattgttgccatatctgactctcattctgatgtctgtccagtctctgtcccatttttagtatgccttgtaattttttgttgaaagacagatatgatgttgttaaccttaaataacaagattagaaaataagtatagactttgagcccaaagcttgaggatggccaccagagagcatagattctatttgccttgaatatacattctgattagcagtgttacaagtgggtttttaaggaaaaaagaaaaggcagttcctaagttgttaccaagaatttacattaaaatatcagaagctcttggttagctatacattcgttctttgtatcacaaactccaggaacgagaagacgatgggtgagacaggtagccagtaaaatgccttcaaacaattgcccctgggtttgaggggccagtgactgaagtcccatactcatgtctctctgggcctactaaattttgcatgcctcacatagctcagactgctttgagctctttttcttttctcaatgtattgggcaaaaggaattgcagtaagtgggccttgagtgatgtagtggcaaggggcgtgtgtgtgcatgtatgtgttggtaaggggccattctgtggtcctatgattaggtcccaatctttagtgaggctttgagactgcacagtgaacaccagggcttctcagcttctcagtacccctgccacctctgtacctcccttcctgccttcctgcttagttgggacaggatggctagaaggtgccagacttgggtattgcccctccttctggtaggttagtctctgataataccccagcaggttaggctctgaaaaattccaaacagattaggctctgttaaaatagtttctcctgagggcaggccttcttaagaagagaatactctggcatatttcagaatgcagcagatattctcttttctcctccctctgttggaagcatgagggtatgtttctctggtattcactatgaggacctggttgagctcttagtggtaaaactcaaaaataaatgtgcggcctccctatgactgggctgcctttggagtttttaatctttcaggcttgtccacactgaacctccagcaattcttcagtcacagtttaggttttcctaaccaggcactggttctctgcaaggtttctgctgtgggtttttaaactgccaagttgtgattctccatagccacctgtctgtccaatttggggacaacagtttgccctgtgaccttacttctcttacatatctaagaagagttgttgatttttcagtttgttcaggtttttactttttgttaggatgctgtggtgacttctggactccttacatactggaagtggaagtctccccataatcttttaaaacttagatttcaaaacaacatgttttatcattgtgatacggctctgatgagtggaggaacaccagattcttcctcttaagttgaattagaaaaaaaacgacatggacacacgtggagtagttttaaggagcagggagtttaataggcaagagagaagggggaggaaagaaagaaaaagctcgcctctacagagacagagggaggggggctccaaagccaagagacagaaccccactttcaggtagtatcaaccagctatactggaaggctggaggaggcagtgtctgatttgcatagagctcagggcattggtttgaccaggcatgtcattcacgtagccggcgaaaaaactggccctcccaccctctctttttaatatgcaaatgcggggcaccatgatgttccaaacacgtggggatatgtaggggcagccatactgccaggcacatgtgggggcaagggcaagaggacaacggtgggaatcgccatgttaggtggacccagtttctaatggctaacatttgcatatcaaaggttgccagcccgggtctaagacccaaggctttcattctagataagagctgcgaaaaatcttccaaggacccctttttttcctatgtgcctaaaataatttcttaataactcctacctcaattgagggtacagcaaccaagaactttgtttttttaaaaaaaaaaatttcttgtaaagatgaaaagatttccaaagatgctaattaaagtgttaaatgactagctggaaaaataacagcttgttattttattgagaaacctaagaacggtatgatgttataaagataaacactcaaaggggctattactattattttctactgagaattaccccagtagccttctcccttttgaaggaggcagggaaatgatgcagtggtattgaggagtgaagaaaaatggtattagtagagcagctaataatactggtgcatattgtttggaggaagtagaaataatgagtggctagtagatttgaaatgctttaagcattaaagatgtcagttcttcccaaattgatctacagacttagtctttattctttatttttttttcatgttctttcatgaggtggcaaatctataggtttattgcagtctctcaaaatcctagcaagattcctttagatagagacaagcttattttaaattttatatggaaaggcaatagaactggagtagttaaacagattttgaaaaaggagaataaagtggaaagaatcactctaccagatattaagccatgctatattgccaccttaagcaggaccatgagataattgcgatgtaataaacacacagatcattggacgacattagcaagcccagatgtaggctaacagaggtattttcaactgattttgagaaaggtgcaaaagcaaaaataatcttgaacaaatggtgctcaaataagagaccaaaaaaaaaaccccaaataacttccccaaagctctcataaatacaaaaattaattcaaaatgggtcatggatttaaatgtacaacataaaactataaaactgttggaagaaaatattggagaacattttctggatctagggcttggtaaggagtttttagatatgacaaaaaaaatcaataaaaatgaataaatgggacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttacgaaaatgccagttaaaaccataatgagatattattacccacctgtttgaacagttaaaataaaaagtagctaatactaaatgctagcaaggatatggagaaagtggatctcttacatgttgctggtagaaatagaaaatggcacagctactttggaagacagttggacattttttaaaagaagttaagcatgtaacatgatctgacctgtcagttacattcttgagcatttatcccagacaagtcaagatttatattcacagaaaaatctgtacttgtgtgttcatagaggctttatttgtaatagcagaataccggaaacaacacaggtatccttcagtgggtgaatagttaacaaaactggtatatccatgcagtggagtactactgaacaataaaaaggaatgaacttctgatatatacaataacccggaggggcctcaagggtgttatgctttgtgagaagaattaaatctcaaaatgttacatactgtatgtttccatttatataacattcttgaatgacaaaattacagagatagagaacagatgaataatttccaggggacagggcctggggaaaatgaatgggggagtaagtagaaatacaaagaggcagtcagtgtgagggagttcttttgtgataatggaacagttatatattgtgattgtggtggtagttacatgaatctatacacaagataaaattgcacagaactatacatgtacacacatgtacatttttaaaatggcatgtactaggcttctccagagagacagaaccagtaggatatatgtatatataaaagggagtcagttagggagaattaactgacacgattacaaggtgaagtcctatgataggatatctgcaagctggggaaagagagaagccagtaatggctcagtccgagtttgaaagccggaaaaccagggaagccgacatggcagccttcagtctgtggctgaagtcctgagattccccgggaagctgctggtgcaagtccaaaggctggtgaacctggagtctgatgtcccagggcagggaaagcggaagcaagcttcatgcactgaaagaagaaagagccagaagactcagcaagcagaattatcccaccttctaacacctgcttgcccacattgagggtgggtcttcctctttcagtccgttgactcaaatgtcagtttcctctggtaacactgtcacaaacacacccagatacaatactttaccagccaattaggcatccttcaatccagtcacactgacacctaatattaattatcagagggtgaaaactgaaataaggtctagtctaacactaatgtaccattgtcaatttttttgttttatattgtgctacagttatcatatgttaccattgggggaagctggtggaagagtacaagggattcattgaactatttttcaatttcctgtgagcctattatttcaaaataaaaatttttaggaaaaggaagggcctctatgacttgcttttctaaagactggaaaccaagcccaagaaattctgtaccttatatttcacctgcagtgcatataaatttggtgagttcctcaagattgccaaatttggttaggctctttggcctacaaggaagtgatttttcttaccagctataaggctgggatctgtaattcaaacttttgggtgttattaacatgtagatgctatgcaaatcatgggataagatgaattcactttgcgaaacagagtaggtaataaagagagtgcaggaccgatgagccatgaggactccaggtgttagagactggatagattaggagtagccaataaagaaaactaagaaggagcagtcagaggttaggaggaaaatcatgatagctgagagcatacctacaatgtcttacggaaaataaaagtaatcattttccccttatatttaattacattaatgtcttaatggatacatttcaggcaaacatttattatgtttttcctgtggatgctagtgtcctgggtgttggaggttgaagtagggaaggctgtagggtattgcctgcttttatgtaagtaatatactttttaccttcaatttactgtctttggggaaatgataaaagcttaagaaaatacttctacttcatagttgtgcccaagttggacagatgttcatctcaattttaattttgtaaattcattcatttatcatgaacgtattaggctgtacagtttttcctgatattctagctattttcttgggtaagaggtgccatagaactggaggaaatactctttagaggagctacttgaagattaactgttataatagagagtaagcgacaaccaaaacaggtttaaaacaaaaagctgcaaaaactatttttacgtctccatataaaataaaagaaaatagtagatgaacaagtgaatcaggaagatctcttggaaaaagccatgtttatcataggaagaagatacttcaaaaaattgaaatagcttaaagaaggaggaccaaagtaaataatatgtacaaaaaatgaccattgaggttctgaaataatattttatcattattttaatgttaaagatgtcacttgaatacatagaaaaatgcaatatgaagatcttaatattatgaaaatatgtccatctttatgctttttaacaaaatggtgggtttttttccctgtgttaattgaaatactattttggcagtcatatctttttttcaattatctgtaaactcagatttgtgcatctatgcactatgcatctgtaaagtgaatagatgcactttaatttcagctgaaagtttgaatcctagcattactgtttttgatttgctgcataggcagtttgcattttaagggtgtaccctttcttttcaattatttttttgttcaaatacaaaatttgggagtagaggttatttctaatgacttaacagcatcatgtggtatgtctgattaaggttgattaaagttgatgccaaataggttgtggtaatgtaaggcctaatttcaggttgaaaaaaaaaaggccccaagttatttctaaccatgtttaaactcagcactagacttgctatttagattgtgaactataacttcaaaaatgctaatgatttaagacacagaatcctactagaacaagaaagaaaaactaagtttcatctgattagaatgttatgttcgattatcatgcgcttcagttttagatgacaaaaatgggaagatgaggaacttttgtggtgtttttcagcactacgtagataatttacatagatagtcagaatgttgattctggcttctggcaccaaaatgttaccaactgatattgtgtgtccttcagtgacttagatcttaccttgattctgtttgtggtatagtttcctacaatatcaccatttaaacaatgttgcacactttgccttcaaactggaaggaccctattagaagccattttgattgagaagggtcattgctggttggcgtattggtctgttaaagagaatctttattgttgtaaaatatataatgctttaagcttgtgtattagagaggataacagtttcttttcttagatcacctgtcatttcataaaatgaaattttatattaatttttttttgaaaagttcttagtggaaatagtagaatatttaacagctttttggaaaaaattgagaattccttctttattttaaacccttcaaaggcagattgattgattgattgattgatttatgacggaatctcactctgtcacccaggctggagtgcagtggcatgatcttggttcactgcaacatctgcctcctgcgttcaagcgagtctcgtgcctcagcctcctgagtagcttggattacaggtttgtgccaccatgcccggctaagttttgtatttttagtagagacaggtttcaccatgttggccaggctggtcttgaactcctaaccccagtgatccgccctccatggcctcccaaagtactgggattacaggcgtgaacctccgcatcctgtccaaaggcagttttaaaaaatgatctaaaaatggtgaacttttctttattagctttaatcataataacactagatattatccttgatagttaatattaatagtagtcatttatatattactacttcttaagacttttttttttttcaaacttttttgccctttggaggaaagatctctacctttttgtataacttgccagtggtattcagtggatcctcattaaaaattattgtgagattaaattgtaaatagtcttttaaaatagctttttttttttttttttttttttttgagatggaggctcgctctgttgcccaggctggagtgcagtggcacaatctcggctcactgcaagctccacctcccgggttgacgccattctcctgcctcagcctcctgagtagctgggactacaggtgcccaccaccacgcccggctaattttttgtatttttagtagagacggagtttcaccatgttagccaggatggtctcaatctcctgaccttgtgatccgcccgcctcggcctcccaaagtgctgggattacaggcgtgagccaccatgcccggccttaaaatagctttttgagataaattcatataccatacagtccactcattaatgtgtacagtggtttttggtatattcacagatatttgcaaccattactatgatctattttagaatattttcatcatttcagaaagacactctactctataccttaagtctctacaccctgtttccctatttccccagccttaagcaaccattagtctaccttctatctctgtagatttgcctattccagacattgcctataaatgaaatcatataacacgcggttttctgagtggcttttttcacttagcataatgttttcaagattcagtcatgttgtaggatatgtcaggacatatgatctcaaccaggtagactgcctggtaagactaagacaccaacattttccagagttttgagaaagaaccaaaagtgtacatgctcatagcatacacagtgcagtccaaaattactcagtctatcaggaaattatgatttagtctcaagagaaaaaacaactaatggcaactgtatttagtccattttcatgctgctaacaaagacatatctggccaggcctggtggctcatgtctgtaatctcagcattttgggaggccaaggtgggcggatcacctgaggttaggagttcaagaccagcctgaccaacatggagaaaccccgtctctactaaaaatacaacattagctgggcgtggtggcacatgcctgtagtcgtagctacccaggaggctgagtcaggagaatcacttgaatccgggaggtagaggttgtggtgagccgagatcatgccattgcactccagcctgggcaacaagagtgaaactgcatctcaaaaaacaacaacaaaaaagacaagacataccccaagactgggcaatttataaaagaaagaggtttaattggacttacagttccacgtggctggagaagcctcacaatcatggtggaagtctaggagtagcaagtcccatcttacatggatggcagcaggcaaagagagaatgagaaaccctgataaaagtggaaatccccgataaaaccatcagatctcatgagatgtattcactatcatgaaaacagtatggggaaaactgcccccatgattcagttatctcccactgggtccctcccacaacatgtgggaatcctgggagtacagttcaagatgagattttggtggggacacagagctaaaccagcaactcaagatgatccacgtatgagaattattggacaaagactttaaagcatttagtttaaatatgttccatgaactcaagaaaaacacatttgttttcttccaggtgaaagacatgatagaagtatctcagcaataaaataaaaactataaaagaaacaaatggaaattttaggacggaaaaatacagtattggaaaaaaaaattaaatgtctttgagaggacaaaggagattacataggaataaagtatattcaaattcaatttggatatagatcaataaaaattatcccatgaaaaacagacaaaaagattgaaaaaatgagcagattctcaggaatgaaaaggtgtaacatgcaagtaattggagttccaggtagtgagaatagagacaataggacagaaaagaataatagctccaaacttcccatgtttggagaaatacatgaatttgtagaataaaaaattgcatagtgttacagctcttttagaattgcaccagaaccctcccctgccgtccaccccacggaagaaaattgcagcaaacccaaaacaacataaattctgggaaaaccacacctagctcatcaaaatcaaagtacagaatacaatggatagagaaaaagtcttgaaagcaccagaggaaaacagtatatcacatacagggaaaaaaaaatggaatgatctcagatttctcatcaagaccacgggggctaaaaggtaattaacatcttcagagtattgagaggaagaaaactatcaatgcagtattctgtatctggggatattttcttcagtaatgaagtgggggtgagggggagacattttcagataaaggtaacccaaaagaattcattgcttcaggccttccttacaagaaatgctgaaaaaagcacttcagaatgtagggcaaagatagcagaaggcaacctggatttttaggaaagaagaaagagaataataattagtaaatatctcagtgtatatgaaatactgtatatatatatattttttttttcttacatctttaaaatatatggctttaaagtaaaagttgttttttgggatattgaatgaatacataatgtatatgacagctatgagataatcgagagaggtagggcataaacaaattctagaataattatttacctttaaagttaaaaaaaaaagtagggggcataaagagccagtggattagaggggagagaaaactactttatcattagacttcccagtgatgaagctttatgataaagatttataataccctagaaaagaaaatgtgaacaaaacagactttcaggtataaaaggcatgtacaaatgttatcaaatacaagaattttaggaatgttgtttccatgaattcctcttgaagaagatactaatctagttagtatagtgtaataatatatactagttagtatagtatacattttctagtataacctactagaaaatgagcttcagatgactaacatggctatagagatatcagtataaggactggtattgctcattaaatagtcagttgtagaactaaagcagaaaaaagttaaaaggagtgagcacaggattaatggctatatgctgtggcatgagcatgtagtataactgtaaaagtaggtagtgataattgggagaatttatataaaatttttttcaaactgtttgcagtaatcaaattagtggtgacagtatagttactgttattttgacattgttgtgtttataacgtgaaatgaaacagaatgattatggagtattctaattttatcccttatgttaagaatcagaattcttggtgtagaagaaaggagatgctgatgtaatctggaagagatcattaaaaaccctaatgtcgtgaatttgaattgaagatatcattgtgggctgggcatggtggctcacacctgtaatattagcactttgagaggccaaggcgggcagatcacttaagatcaggaattcgagaccagcctggctaacatggtgaaaccctgtctctactacagatacaaaaattagcccggtatggtatcacacgcctgtaatcccagctactcaaggagctgaggcccaagaatcgcttgaacctgggaggcggaggttgcagtgagccaagatcgcaccactgcactttatgtcagtatgaacttctgcagtatttcatacacacacccagtacaccatacatacagctctgtgtggtgaaaataactagaaacagtgaccagcacgtagcagtgagcatccctattgacagattatcgtcctcacatacgatttcctactgcagggaaaacaggctacttggagaaattgctgactcaagatctagataggaagtgtacaagatgagccctgtatgtcttgtcatgccaaatagcaaataagctttcaaagacttttagggtcatgtttgaaggatacaggagtcaaattggaaaggttactagtggcgtaagatgggaaaatttcaaatttaatagggataataatagaaagaaatagaaactcatcagatgtgcctgtattaatgagttttaatgagtgcataatgtacctgtaccagcctcagtgccttggagatgaactgaaaatatgaacagtacatgtaatgaatgattacttggtagtttatcatatgctgtgttaaagtataggatactacccattatccagttatttatttatatatatatatatttaaattagacttcaagtttgcagaggcatagactatgactttttttctattgtactcagtggatatattttatgatgtctctctggaggttttcttcatctagacctgcagccttgtggtttcaagggcttctttctgggtgttggttaataggttgctgcaacacagcactacagttgtcaagtcatattttaggaacagttgctgttatatctggaatttagaccatgaattctatataagttccaaaaggggttatatcagtcatgattgcatggaatgtacacgaaaatatatttcctgataatcaaattatttatctagttatttattcctttcatcttcactgtgttccataatgaatttagataattagaaataagaatgcatgcaataaatcaatggcagaatataaaaaggaataaagaatcacaaaatggaaattatattttaaaatgaagaccccaaaccaaggagaaataatgaacagaagtcgagtcatatgcttgaggcacaccagctttctgttgcgtagaatctctccctgagggcaagcaggttacatgaaacttagtgaaacttagtggaatatacgtgctttcctatctttgttttaaatcttaaatactggattgaatagattcttaggatggaatgtatttttaaagtaatttttctttaccctagtccaaaaaactaaaatgaaaaaccagttaacttatttatggttttcttcataactctttttatctcatgtagtttcatagtcaagatttttgattacagcttttattaacctcatctctttaatgttgataatattttatataatgtggttgagtaaagtgtaccgatataggaaatagagcaatcctattttaatagaatttgttgggggggaaataccacataattcatatctagagagtttttcatctgttatcccataagaatttcatgaaggattggtatgtgctttgcctataccagagctttgcgctgatttcttctctttcagcttagatttgtgggtatgatttggcagttatcctcttggaatgtgtaaaatcattacttttacaatgagatagaaatattttgaggcctaaggcttactcaaaattctctcagtctcttacaggcctgagtcacatttcaaaattggaatttttcatattgctaatggaggaactatttttatagtattgtgaaactattaaagaataggtaatgttatatggatgctcctcgacttacagtgggctatgttccagtaagcccatcataaagttgaagaatcataatttgaaccattgtaagttagggaccatctatagttaaaaatatagttaaaaactgttacactagagtataggtgaactcaggatgtgcacaattaggaatttttaaatataaatatagttactatattacagttcagttggtatttcagtaactacaaggaatttggggcaactacagagttttagaggaaaccttccagttagaccactccaagttctgacaccaattggaagttcgaggggttcccaaaaccacctcttagttttgataatttgcaagactcacagaactcactgaatgctgttatacttaacagttgtattttattacatggaataccgattttattacatggataccgatttaaatcagccagaggaagaagtattaatatatagggtagagttaaaaaaaaaataccacatgtggagcttacatcattctttcttggtggaattaggacagcccagcatacatatatgatagtgcttaccgagtattgccagccagggaagcccacctaagcctttggtttttatagtttttttagggtggcctcaattacttactgcctgtgtgactgtctttagtctccagcccttcccaaatgttgggctgatagctttagtctccagtcctttccagaggcaaaacatagtatgactcaaataaattacatgtatcataaattacattggtagattgtctagtagtcaaagacactcctatcagttgtgctattccaggagcctagcgaccatcttccagtagctgaggataaaagccagacctctctttgggcaagattaggccttcactatacagataattccgtggtctttaggcaagctttcctatgatatttggacatcttcatttagtgtaatgttcatatggcagatacagcaatagtatcggtttgaatgtatctgtcatttggaggagccaatgcagggtaattgaacgaaacttctggtctatcctataaagccattatatacgttttcatatttttgtactaatgtaattacttgtttcctccttttatctgtcactatttgtacttgtacagaactatttagcatagaagttacttgataggtagctaaatgtagttattcctcaggctggccatttgattagatcctgaggagcctttaactgaatctcccagtgagtattcctgagatcagatgctattggctatactgtagttttagaaggtttttcttttagtgatatattatttatctacatacaagtatttgttaaagagagttagtgtaaagacatgttaatatataacaggataatgagaagcataaaataattctataaatttgctcaagatgatttttttttagcttagaaaaccttattttgaaataagtttggaatcacaggaaattgcaaaggtagtacagaaaggtcccatgtacctttcgcccagtttcccccaactatactatctatcctactcatggtaggacttcttccttccgtctcagtgggcagtggtttaatctgcattttattgccccattactccccgcttttctcttctttttctaatttgctgaatttgaatgtttattttcataattacacataatttgaatttcatagtagtctttctttgaattacattttaaatgtggtatgtgggttgttttacttgttctccttgttgattgtatctggatggtttttggaaagatgcagagaaagattaggatttgtataaccaccattattttgcagtacctggaattatagaatcattagttttttattcccataattcttaaataatagcttcactacccagtggaaaagattagtttgagaaaagtttactgacagaattttttgaataactgttttctcaaatgtaggatgaaccccaaattaatgttccataaagaattctaatttctgactgacagaaaggctgttggtgatgtaattttaccagtgtggactttcttttattactgatgtaatatttctttgacaaaattaagagacaatttcaaaaagcagtttcattttaatataatgcagtatgctgtttttatgagtataaaaaaggaggagtaggaaaattagaaaataaaagtattgttttagaagagtccactaccctaacctatataaatgataaaaaggaaccgaatgggagatattaatgtgatgttgctgggaagagaaatgcctgtcttaaattagtggttgtcagggaccaatcccctgtgcaatattttgattagtggtgtctgggttggggccaaggtacatgcaattaaaataaccctctatagttgaattcagtgtccagccagaattgaaactatatagattaactaatgtcgtatccgcattttggtcttatgggggtaatatttgtaataatcatgcttttggtactgatgttctagtgaagttaaaaaaaaaatcacccatagaatgttgccctttcaatgtaatcgttgttttagaatgctttttttttgagacaggatcttgctctgtcacccaggctagagtgtagtggcatcgtcacggctcactacagctttgacctcctgggcacaggtgatcctctgacctcagcctcttgggtagctgggaccactagcgcaggcgtggaccactattcttggctaatttttgtagtttttgtagcgatgaggttgctcacgctggtcataaactcctggactcaagtgttccactggccttgcctcccaaagttctgggattataggcgtgagccattgtgcccagcatagaatgcttttaaagtttttaaaactattattttaaaactaaaatcataaaacttttaacccaaatcttatttacttttgtttagggacaaggaaaattattcattttagaaactttaattagtgtacatgttttgactaatattcaaattatggaaaacttgaataatgtttttacagtaatagatattttatctcttccaaacatttctcagttttcatgaattatcaaagttgaaaataatgttttacctgaactttcctttcactccttttattgacaattcttagtatctggttgtctggctgccacgttatttgcaagacgtcactgactcagagtggttttgaatgccagatgttattttgctgcttcttccagaaaatggaatttgttgggctactgttccacttaacaattgctgtgtaacacattatgttctccagaagcaggcactgagacagaatgtgtcatgcagggtatttattaggggttaacacctgtagaagggaattggagaaagcaggtttgggtggaggagaagtcagattacactgaggccaaagcttcagtcagccctactaggagttctgaagcgtctgtggtcacctgaattgttgctagtttagtagaaatggcatggtctttcttatttccttatcagtcattcaatgcatatgaagttctccaagaaacacaggcagttgtttaaagaggctctctgtaactttgaaggaacctggcagtggggagctatctgttgacatctggggcaaagctcatcattgagggagaagataatacatctctgtccaccatacaccctgaaacactatagtgactaatataaaacaacaacaattttttttttcttttttttttttgctcatgagtctgaaatttgggcaggactaggcagcacctaattgtatcttctctatgcagcatgagttgcagtagctcacctgtggttggaagaatcactgtcaagatggctcacacacatagctagccaattggtgctgcccatcagttgggagttcagccagagctgtgggcatggggtttttgttcttcccatgtgggctgcttgactttcttaacaacatgataagtatgttctctagagcaagtgtctctagagaacaaagcagaattgcatgacattttaatgacctagccttggacgtcatagccagcctaagttctatcatactgtattgattgagacagtcacaagagtccatccaggttcaagctgaagggacaatcttcttgatgggtgagtggcaaggttctagatgaaaatgtggagtgagagatattattgaggccatgtttgaaaaatatggttttctgtattcataaaacttaaaagttcagggtgccttaattagaaataggattggctacatcttttagaaaattcaaattaataatggtccaaatgtatgaggagggctagtgactgaatgaggtccttctgggctacggccctcacagaagcaactaaaaatctgagcatagcacaaagaccattatcctaaaggcactaaagagtgaacagaagcggggagaacctgattgggaatacatcctcaaagaagatggaggtatatgaaatgacatctcatgttttgcagctctcagcctggggctgggtgaaaatggcatggtgtacattgtggcatgggagaagataacaagaagataagtagaagaactctggtctctatggcctgtgaaagctgaatttggggaaactatgtttgttagagaggggatccaaaatctgtctactgacagctcacatgacccctgagtgatagcttcactcagagctgctcagctaaagacaaaagataagaaacttcttcccaagaaacagtttgcagtttaaatgtgtttaatcagctgattaaaaaaagaaagaaaaaaatgctaactggagaaaaattaaagaatccagagtttcagaaatttaacatttattatgttcagggaacattcagaattacccaatgtataaagaaaaaggagtatgtaactcctttacaagagaaaagagtatccctgaaatgacccagatgtagaaattattaatagcagactaggatttttaagtggctgttaacaactattctcagtaaaggtaaataaaatgtgttcacaatatatgaaaaaataggaaatctcagcacagaactagaaacaaatcaaatggaaattctagaaatgaaaaatacaaaatctgaaatgaaaattttcactgcaaaaaattaacagcctagtggagatgacaaagtaaagacttgaagttaaataagccagaagttattgaaggtaacagagaggaaaagattaaaataatagtagtccaaggacctgttagaaaatatcacaaggttttatgtacatgtactttgagatcaagaaggagaggaaagagaatgggccagaaaaaatacctgaagaaataatggcctcaaatttgatgaaagatataattttatgtatttgagatgctcaagaaacaccagggggccgagtgcagtggctcacgcctgtaatcctagcactttgggaggccgaggcggatggatcacgaggtcaggagatcgagaccatcctggctaacacggtgaaaccccttctctactaaaaatacaaaaaaaattagccggacgtggtggcaggcgcctgtagtcccagctactcgggaggctgaggcaggagaatggcgtgaacccaggaggcggagcttgcagcgagcggagatcgcaccattgcactccagcctgggtgacagagcgagactctgcctcaaaaaaaaaaaaaaaacaccagggaagataaatatgaaaaaggccatgtcaaggttcattatagtgaaactattgaaatccaaagacagagagcaaattttggaagcagcaaggaaaaaatgacaagttacatttgggggaactacaattccattaagagatgaattctcattagaaaataaagaagctaaaagagagacttaagaattctatatatccagtgaaaatatccttcaaaaataaatgtgatatgatatttttaagtaaaagaagaacaaaaagaacaagaagccaggggtgatggctcatgcctataatccctgcactttgggacactgaggcaggcggatcacttgaggttaggagtttgagaccagcctgactaacatggtgaaaccctgcctctactaaaaatacaaaattagccaggcttagtggcgggcacctgtaatcccagctactcaggaggctgagggcaggagccttgcttgaacccaggaggtggaggtttcagtgagccaagatcatgccactgcacttgagcctgggtgacagagtgagactccgtctaaaaaaaaaaaagaacagaagaatttattgccagaagacctgcactgtaagacatgctaaaggaagttctttaggctgcagggaaatgatactacatgaaagcttggatctgcagaaaggaatccaaggcacttaaaattgtaaatgtctagatatacatactagactataaattttttattcttactaatttcttcacaaaccatatgactgcttaaagcaaaaattataacattgtcttgaactcatcagagatttgaggtcatagggcaaccaactaacctgaaatctaagaaatgacaggtacttccaaggaaaagatcattgaggtacaaaggagagcagagagctgcatattaagaaagggcagcattaggggaatggaaattatgcttctgggaaaagaggaaccaggaaaggaaactgagaagcattaattttagatgggagaaaaaatagagaagaaagtggtatagttgggagaataaccagcagtgtcagatgtcatagagaagtcattacaggattcaaactaaaaagatgctactggatttggcagtgaaaaggtcatttgtcatcttaaagagtattttctgcataatgaatagggaaagggaaagccaaaaaaaaacttttggacaacttcttttcagcactcaaattccttttaagaattgatcatacatttcagtggtaatgtaaggacgaggacttgcattttcttggagcaggtataatcataggtaactttatacttatgaccttcattatttaaaaagattttaccaaatatggaatgcaaaacattttctaggaggcctctagtttttattcttatgtagtattgtaagatgccaaaatcttagctcagtgatcaaattatttgtacagagaataggtagatgtttatctacctacttttctttgatcctacttcttcaagatgttggaaccttttgggtttgtgggtactgtcaattaagtgtaaccttctttctgttcaggtgacactagagagctcttgctattcctcctctcttgagcccccctcccccaagtttgaatgaagtatctatgcttgttttactgcctattgagaacatccttatgaagtaattaagagccttctttactcagttgatagatgttggtcagcagaggcattgaggcacccccactcccgcccctagtgagcactaatgggaattggaatgtgtggcttctcctcactttgtttacactttagagtacagaaagaaccagggtggtccttgtataagttcagcttagttcacatcatactttgccccaaacatttttcttatgactactataaatttagatttaaatgaaaataataggtaagtctgaaggaaaaaggaaacctcagaaggccaagctatagtcttggtcaaatgttttcttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactagggagaagaaatagcccaccctcctgaggcctcgttatttcgaaggttaggagagtttccgtctgcccaaatagtgaccattttaagaacagagacttcagccatggaataaaatgagtaaggatgtggagtgagtcagtaggctacatactttattaaatgtataattgtactcattgttggataaacagagaccaattaatattgtcattttaacatcatggtgcttatctgtgatattgataaccattaactgtttggactaaaatatattgcggactgcagatgatcttagtggcttagtgaaaacattttcatattctttgattaaatgattcagacatttacacatgtatttttggtttttaattaattttaatcaaacaatacttaacacagtaaagaaaaaactaatacaaaaaaaggttatattgaaaagtagtctctccagcatacctcttatgcctgctccctagtggcagctatattcaattctattttttaaaagttatttagccccatatctctaatgtcctgatatgttgatgtttctagatttgcgaattttggacagtttgtaaagacttcttttgcctgccttctatgctagtggaggatttagctgtttgtattcctctttctacttttcctccctgcattctctcactatacttttatcactatttttgatcttcttggtagataatggttgcatttttgagactttgtaaatattgtttattgctgagccaagaaatatactataattttttcctttcttatctaacaatttttcctataattaataataggctcaaatttgttttcagttgtttgtcagtactcttaaaatttccttttatgtgtactaaatgcctaacagtacattttcaagtattcgagtacatcaaatcatgtatcaagtcaatttagttcctttctcccaaccttgtaggcagttataattcagcttccttggctctgcattatttatcatatgtatgttctccatctttgaaaattgtgttgacacccatcatcttccattgtcttttcttacattcacttgtgggtttctaccttttagttcttgtattgtcattttactgtagttctggagggagcagagataaacatgtttactcccataaatatttttggggtgatgagggaataagaagaaggatttctgttttctacttttatgtactcctatagtgcatagtattgcatttaattcagtgctgttgcatgctgtaaatgtttaattaatgcttattgaatgttttactttgtcagttgttacattcttatcccaaccctcactctacccccaacatgcttatgggatcctgaaattttatttcctaaaacctgtctttctctcagctgctaatatataacataagattatttatacaagaagactatgtattgatttggaagaaaatgtgaagtgataagagtaatgttgagccctttgcattttagtgatttattgagagtttactgaatgttttgaaactaggatctggtttccagagtctgaatttttaaaaatttagttaggggtgtgtgtgtgtgcgtttgtgtgtgcgtgcacgtgtgtgtgcgctcatgcgcacgcacttgaaaagagataggagtcttgctctcacctaggctgaagtgcagtggcatgatcatggctcacaacagctttgaactcctgggctcaagtgatccttccacctcagcctcctgagtagcctcctgagtagctgggaccacaggcatgcaccacaatgcctaagatttaatatttttttttatagagacagagtctcactatgttgcctatagatgagacatgtaagttctctgtggaaaataattcataactgaagaatataaaagaagacttataggtttagtgtatatacagatgggaagtgtcacattgcaaagatgtcagttctcttcagattaatctataaaatcatgattcccataaaaatttcaatatgtattatagaacatattaagctaattccagcattgatctagaagagtaatggcaattaaaaaatatgctctgccgataggaagctcattattttataattaagacactgtggtattggtgcaggtagaggcatatggatagggtggccattcatcttggcttgtgtgggagagttccaatttatgcctgttatcctggcaattattaataggctccctttcactgtaaagattgtcaactgaaaaaaaatagagtaatacagtaatatttttgctcttcttgagagtcctgaaacacacccactaaatttatgacctatgtggtattagataatagtggtgaaaggatatcattcagtaaatggtgctggggtagaaagaaatgtaactgccctttatctcacactacacacaaaaattaatccccggtagatttaaaaactggaaaagcataactttaaaacttacacaagagaaaattaggacaccatccttatgatgtctgggaagacagaaatcatagtataaattataagactacattagtattttatatatatatatattttttttttttacaaataagaaggacattaaaaacaatggaaaaacaagcccacatgcagggagaagggatttgtaacacatcatgaagaactaagttcgagtaaatagaatccctgaagattaaacaaaaaacagtgcacacacatttttacaacggcaagggatattaacaggcattttatagaagaggaatgtaaaatgaccaatgataccagtgataatatgaaaaagattctcaactgtattcgtaatcatgctagcaaagttgaagatgtccatatctttcatctcagaaatttcacttctacatctatagtctggagaagcattcatatatgagtactagaagacatttattaaaatattcatccagcattctgtgttttaacaaaataaaaatgggcaacaatcaaaattccgttatcaggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacacacacacatatgtttggaaacatacatatatgtttggaaacacacatgtttggaaacatacacacatatttatgtttggaaacatacacatgtttggaaacacacacacatgtttggaaacatacacgtttggaaacaaatgtttggaaacatacacacgtttggaaacatatatgtttggaaacacacacatatgtttggaaacacacaaatatacacacacatatatgtttggaaacacacacacacacacacacacacacacacacacatatatatttattttattttatttttttcttttggagacagtttctcattccatcacccaggctggagtgtagtgacacagtcacggctcactgcagccttgacctcccaggctcaggtgatcttctcacttcagcctcccaaatagctgggatcgcaagcatgtgccatcctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtataaaatatgcatggatacagcaaacaccaaatttaggatagtagctgtgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatagcttaatttttaagataaagaataaaatattttttcctcatctaaaaatggtcttagtaattgctaagcttccttccagaactaaactgtacttctttgatgtttcccctacagcagatctttttcaacaggttagaatacagtcaaatgttgaggattataaagctaataccctatacagattgttgttttcaatcaccctgtctctctttagcaaccatctatcatctacaataggggtttgaaaactttttctataaacagcctgagagtaaatatgttaggctttgtaggccatgtggtctgtgtcacagctactcactttgcctttgtagtgtgaaagcagacataggcaatacctaaatgaatgggcatggctgtgtttcaataaaactttatttacaaaaacaggcagcaaaccagatttggccgtgggccataatttactaactcgtgatatacaacacactcagagaaattgcttcagtaatcaaagtaatactgttataatattttacccttattatgggtggtaaaactgaagcatagagatcttaaatggcattattcaggttaaagtagccctcccatattcctgtaatttacatggcaatgtaatttttaaaaaaatatataggttctccagagattctttttctccctctaaaagtagagtgagttgggtgggtataatctcttagttattcacaattacaacctttactatgattagaaacttaatattgttaagtccctgagaatcttctttacagaaccattttatatatgattatttttctaaggtttgcattcacatgcaaaaacaaatacaaaagctggtatatgatatagtttagatttgggtatcttacacaccattgacttaacatccaaagacaatgaaagctttaaataatatagacaatctattaggcagttgttttagttcttctgtaaaatcaactttatgaagcaatttctttgtgttgtcatgacctgcagtaattgagactttatctatctgcagttatcttaaggtctagaaagtatatttttccctgtccagtttcatgggctagaggatagtattttttgtggttatcaggtaatgttgactcttctgtatgcagaaagtaggtctaccatagtcacattggaatctgtgtaaatcaaaaggaaagatagtaagattaatttaaccagaatgaaaattaccacactactttttatctctagaagaatactgaaattacatgtgtttgagaaagttttaatatgaatcagaaccaggatttgaattaataaagtaattaaatagattttcttagaatattacttttaaaataagttgagatttttttctgacaaaaagaatatcttaccaaacaatgaattgtttatttttccactaaaaattgaatttatgtattttttcagagacattaaacctgacaatatactgatggatatgaatggacatattcggttagcagattttggttcttgtctgaagctgatggaagatggaacggtaaataaagataaatcctaaattattttgttcacagacatttcccttgctatttgtctgatatatctgttttagaaaccatctatttatactatctacccatccatccatttgtctatctatgcgccacctccttccacaaaggcatttgggcatacttacagtggggttgtctaaaaagtcacaagccatttcagctgcttatatcagtgatcttaagattgataaaatataccctttatgagacccttgtttgctccttctttagttggtgacttctgttgtactttagatatttcaaagttcaccgggggtaaaagaactaagtctcacatagaaaaagaaaacgcagctttgcccgcacttttacttttttgtctttctttcctaaattgcttagttattctaagggatagtgttcaacaaatgaatccctttttcagaaagttcacaagttgatttagtttcatgttcccatttgcttaacttttgctaaccctaaacccgtcagttggttttttttgtttacttaatagctgggcatggtggtgcgtgcctgtagtcccagctactgaggagtctgaggtgggaggatctcctgagcatgggaggcagaggttgcagtgagccaagattgcaccactgcactccagcctgggcaacagtgaagtcctgtctcccaccccctcactcccccagagccacccagaaaaaaaaggctgggcatggtggctcacgcttgtaatcccaacactttgggaggctgaggcaagagcatcacttgagtccaggagtttgagaccagcttaagcaacatagtgatactctgtctctgttttaaagaaaaaaaaaagtttatatgccacagttttattctgtttttttttcttttaacttcatttttttctggccatataggagaggtccaaaaatatatcagtttaattgacagaaactttttggaggacagtttagtataatacattccaaaagccatgaaaatgtcacattactctagaccagtaattttaactttggaaaaattttattattttttttttagacaaagtctctgttgcctaggctggagtgcagaggcgccatcttagctcactgcaacctccgcctcctgagttcaagtgattcttctgcctcagcctcccaagtagttgggatacaggcaagcaccaccacgcctggctaatttttgtattttttgtagagatggggtttcaccatgttggtcaggctggtctcaaactcctgacctcaggttatctgcccacctcggcctcccaaagtgctgggattacaggcgtgagccaccgtgcccggccaactttggaaaatttgtcctacagtgataactttgttaaaaagaattatgtgacctctgtctctggccatgatagagggattaaattggtaccaaattagcactcccactgtaaggaactgtaaaactggatacaatagttgaagctactgttttccagcagtggacaacaggcagcataatactattatccctgacataaatgaactcgtgaggtattcctcacgattgcgcaaagactggggcagttcctgactctgatgcagaaagctagagtgaaagcagagctggactacctgcagcagctggaatatgcagggcttggcattggagaggagggaattgtgcagagagagggcataaagtgcctcatgaaggttgggctgtgcattgtaccacaagaccatatgaggcttgacaatagcaaatgatagcatttgaaaacagaccagaatactaatgatcaagcagatctcccaggcaggaaacagtgctaggggaaattgaattttcatccctggagagccagctaacacctttgtatcacctaagacctactctctaacaacctaagtccaagccctgattagatccatagagtttggaagtcttccttccaagtagaggggcttatgacaaatcttagatttttgtatgaacctacaatcacagagtgtatctgtaagctaactcatggtcaaggagatcagtcagtaatttttttatgtgcttacataagaattgtttttcttcataagaagataatagaatcaatactctctataacatcttattcacaatgacaaggattcaaaaaaaaaaatcactgaaccaaacaaaaatggggatgtggatagtgatacagagtcagataaaagcagtcagtagaggcctggctggcacacatgttggacttagcagacagagaattaaagaagtgatcataggtcggtcacagtggctcacgcctgtaatcccggcactttgggaggccaaagagggtggatcacctgaggtcaggagtttgagactgcctggccaacacagtgaaagcttgtctatactaaaaatacaaaattagccaggcatggtggcacatgcctgtaatcccagctactcactcaggaggctgaggcaggagaatcgcttgaacccaggaggtggaggttgcagtgagccaagatggtgtcattgcactccagcctgggcaacagaatgagactgcgtctcaaaaaagaaaaaaaaaaaaaaagttataaaaatatttaagaaaacaaaggaaaatgtagccttaaagattacacaaataaggaatttcagcagaaaaatgagtcaaatggacattttacgattagaaagtacagtaactgaaatttaaaattcactggatgaggttaaaagtggactagagataggagaagaaacagccagtgaacttgaagacagatgagtagagatgagccaatgtgaaaaacagagaaaaatattgagactaaataaatagaggcttagggatccatatagaagaagagagtgagatgtggggaaaaaaaaatgtgtacgtaatggctcaaccttcccaatgtgatgaaaaactcagatctaagaattttaccatatctcaaacctataaagagaaccacatctggccatgtcagatgtggttaaagtgccgaaaactaaagattaaaacatttaaaagcagccagaaggaaagacatattacgtacagaggagaaatggtaaggactactgacctgtcatgagaaatcatggagtgatgtctttaaagtgctgaaggaaaaaaatgtgtaaactgaggtttctgtattaagaaaaatatccctcaaaaatgagagtgaattagacatcttcagataaatggaagatgagaaaaattaatctctagcaggcctgaatgctaaagaatgtcctccatgtcaaaggaaatgatactgtttggacatttggatttatagcataaaaatatcatatgcaataaataagtgggtaaataaaatgtctatactgtctttcttatttaatttacataaaaggtacctaactgttaaaagcaaaaataatgtaatgtgtaattatttgtaatgtgggtttatgacatgtagaagtaaaggatatgacaatagtcacataaacaatggaagatatgtatatggaattatactgctctaggataactgtatataggaaatataaagtgagaagtgggtagtgccaggtatgacattggaagagggaaatagcatggtggtgttgctgagttgagaaaacagagattgaaatcagggaggctttagcatctggaatttggggccaccattccagagaggatagagctgcagggaaaaataactccacggagagagctagtgattctccagtcctgcatattacaagcccgatggactcaaagttggagatagagtccctgtagtctgatgtttgcctctctaaattgcttttgaatgcattcgaaatgcaaattccagaatgcatgagtaatatttctgtctctgagtttcctccaattatatttgttcttgaaagtctggtgtgtcctcccagtcattcattctgatttttctggacaataggataatattttatgttttgtttctagcatacttattgatgaactcaaaatggttttcttggacataatatcaagttggacttccattttcaaaaccataggctttgagaggcctatggcaggcctctcaaagtctttgagactttgggaggccaaggcaggagaattgcttgagcccaggagtttgagaccagcctgagcaacatagcaagacctcatctctacaaaaaaatataaaaaattagttaggcatggtggcatgcacctatagtcccagttactcaggaggatgagatgggaggatcgcttgagcttgggacctggtcaaggctgcagtgaccgtgatggtgccattgcattccagcctgggtggcagcaagatcctgactccagaaaaataaataaataaaaataaataaaaataaaaaaaaactataatgaagaaactttattttatttcagatttttaaattaatttttagattttattgtcttattttttgaggcagggttttgctctatcacccacgcaagttcagtggtgctttgagcatttcatttacttacatatttcccataaccatatttgtgctgctgtctcttgattatttatttttagatactaactcatactatcctaccatggtagatgaggattcaggtcttttgctctgctcttgcccatccagtacacatcctctctatcctcccaatgtaattatcacacaatacctcgttaaatcctgtttggtattttattatgacaatacaaatactcatcgtcgtgtcatagtttttttaaattgcatttcttttcttcagaacctttttattcttcctggtgtaagtgaccactttgctctgcttaatttcccgtgtaattgtcaccaatttatcctcaaactctccaccacgttgaattacttaataaaaggaatttagcagttcctttttttcccatggagatattcatactggagtcttgcattctcctaatctggactgttcgttctagagacctactgcataggtactatcctaggactacctttcatcgtcttcatggaatttatgttgttctctagtattggactctgtttcctggatcctgtgtggtgatagctgcctgaggaaggttccattggaagtaaatatttcataatcttccatgtctgaaaaatgccttcatattgtattgatagtttgtctggacatagtattctagatttgaaactattttcctcttagaatttagaaggcattatgttgtcttttaacttacagtgttgctgttaagacatctgacaccattctgagtctcagtccttttattacagcctttctctctatatctggaagcttttagaatgttttatttattcccaatgtcctgaaatgttatgattgttgactttgtgtgggtcattatttattatctggacagctgcctcaaatctacgagcttttcccaagtttgtgactttcaaattaagtttcaacttactttttctgttatatctcggtcaaaaccataccagctgaatcaatttaccttaagaagtcaatttctgatggtgaggtgtttgctataattctttttcttgctctaaaattatcttggctattcttggcccttcatttttctatgtgattgttagaattagcatattgatttatatccatacatgtacatacatgtgaacaatccttcataaacactggcttatgtatttaagacctgctttgaaattagcttaattttgggaacatttatgtctataacatggaatcttctcatctatgaatgttgtgtttctttttattgtttcaggttttatgtctgttaatacagttccatgatgtttactattaatccattacctagatgagttagatttgctcctaaacgacttatggattttttaatgttacctgtattataaatgatacttgtttaaatttgcagtttaatagtgtgttgctcttctttaggattagaattgattttgtatattcatcctgaatctagcaatcttgctaattttttatcggtttaaaatagtttatagattcttctagatttttcatataataaatcatgtaatccgtaaattatgagaaactttgggtttgtttcttcacaatctttatatgtgctatttttttctcttaccatggagtctaatgaccttcagtacaatgttaaataggtgcagtaatgtttctgtagcttcaaattaatttaatgtttgcagttagcttttggtatatatatcttatcaaattaagaaatcccttctcatttctgattaccagagtttttttgttatgattctggttgtaactaaattacttttctgcatccatcaagatgatgttaggttgtttttcctttaatcagttaatctgataaatgacagcttttccattgttaaatcattcattctttgagtaaatatgactttatcaagatgttatattgcagtattttaacacattcctagttgactctactactattttatatagtattgttacctggcattcatacatgacattagtcatatctcagactggagtataattttttttccttaaattgttcttgtctgatttttaggtttaggtcattttagccttataaaataaacagaggacccatattttccccttacccattttggctctagaacagtttatagtacagttatctgttaacttatgtcattggtagaatttacttttaaatcaccttagcctgggtgaagttttgttttcttctattttattttgttttgcagatagattttgtactattgattcaaatttttaatgattataggtctgttggactttctctttcttcctgagttttaatacgttatagtcttttcaatgaaaattgtccattttctctgagttttcaattgtattgccataaagtagttcagaccaccttcttcctagttttaacatctttgttacagtgtcattttgccccccttttcctagtattgtttatttgtgcttctcttttccttcgtaagttttgatacagagcattctactgttcaattctaaatattttccaacttaagttagaattcttctatgggccactatttagtgatatgcctttttaatattcatagtattatatttatttgtttagttagttattcctggtttcagtttactgtagattgggtctatttggtatcagatttttttggcattttttgaaatttgctttgtgattttgtaacaggccagtttttatatgttctatgtttatttgaaaagaatacttttttttttctaacttttgggtacagatgtatatgcccataagattaaaattgctaattttgtcattcagtttttttgtgttcttaaccattttatttctctgatctatttattcgttttttaaaaatccttatgatggtaaatgtgttaactttcctttgtaatcatcaatgttttgcacagctcttttgtagctttgctgttaggtatatattattcagaattgacatttcttccagggtattttcttttatattatattaatgaattttaaaaaaatcttacaatgattttggcatgaggatatatttaattgatattactgtagctaccttaagtttcttttctttatcatatgcctgatatatccctttccatccatttacttttaactttcctgcgtccttatgttttaagtgcatcccttttaaacagattattgctgatgtttttcccatttgttcattttggttttgtgtgttgtcctgtgtaacaggtttgtttaacaggtgaatttaatccatgtataaattttgtgattattaatatacttatttctagtatcttacgtgcagtttattattggttttgcttgtttctttgcatgtatgcttgagtttgttttcttctttcttgccttctgttgacttgatcaagtttagcttttaaatttctctttgtttggaagttacatttctaagtattttagtgtttatctttacatttttaaacatttgtagtttacctgctgtctagagtttatcggtttttctgccacattccctatcaaaacaagaaacttagattacttcacactgtaattaactcaacgtgtaacactcacaacaaaaattaactcaaaatcggtcaaagacctaaatacaaaaactaaaactgtgaaactcttaggaaaaaaatagaagggatacttttatgaccttggatttgtcagtgatttcttggggatgacacaaaattacaggcaacgaaagaaaaaaatagataaattcggcaatatctccattaaaacttctgtacatcaaagggcacgatcagagtgaaaaggcaacatggaatgagagaaaatatttgcaaatcatatgtctaataacaggttagtctctaaaatatgtaaaaactcctacaagtcagcaacaaagaacaaaggaccctgttaaaaaatggacaaggtatttatttatttgtattttattttattttagagacagagtcttgctctgtcgcctaggctggtgtcagtggcgtgatctcggctcacttatcctgcctcagccacccgagtagttgggatttcagacatgcaccaccacacccagctaattttttttttttttttttttttgtagagactgggttatgacctcttggccaggttggtctcaaactcctgacctcaagtgattgacccacctcagcctcccaaagtgctgggacaaggaacttaaatagacatttctccaaagaagatatttaaatggccaattagcacttgaaaaggtgctcaacatcactaataattagagaaacacaaaaccacagggatacaccatctcacactcagcaggattgctactatcaaaaaacagaaaataacaagtgttgtcaaggatgtgaacaaattaggatccttgggcactgttggtgggaatgtaaaatatggaaaatggtataggtagctcttcaaaaaattgaaaatagaattaccacgtgatccagagttcctcctctgggtatatacccaaaagaagtgaaagcaaggagttgaacatacatttgtacactcatttttagagcagcattgttcacagtagccaaagggtgacagatgaatggataaacaaaatgtgctgtatacatacaatggaatatcaatcaattttaaaaagaaaggaaattctgacacgtgctacaacatggatgaaaccttaggacattatgttaatgaaataagccagttagaaaagtacaaatattttatgattccacttatgtgagataactatagtaatcaagttcaaagaaacaaagtacaatggtggcttccagggtctaggggaagggggaatgggggaattactgatgggtacagagttaaaattttccaagatgaaaaaattttagagaaggatggtggggactggttgcacaacagtgtgaaggtacttatgccattgaactgcacacttctaaaaatcattaagatagtaaattttatgtctatttttaccaccattaaaaataataattaaaaatttaaaaaacctaagaaatttagaatacttgaatcctgtttacaccctcagtaatatgtttttgtttttccagtgtttaatttccaacttctttttttttttctttttttttttttcagggaggtaaagtgggtggtttttaaaaatttttatttttctatttgtaaactgacaaattatagttgaacacatttatggggtaaacttatttttcagccctaaggtggttactcctgcctctttttctagtccttgtcctccttcttcttcattatgttatccaattaaccaccatttaaatgaattagtaaagtttactaatatctttgttcataattgcttctagtatcacattcttccatcttggttaaatttcttgttttccgaagtataccctttagtgcttgtttagccgaaaggaaatgttagcgatagtttactcagtcttgtgtgaaaatgtatcatttctgtatcataatttaggtaggtaggtaatactatattgacaattattttttcttatcactttgaaggtacaacttcattttcttctgactgcaattcttagttattaataattcagctgttggtctaattgtcatttcttagtagataatctctattctttaatgtttttaaaatctctttggctttggtattctgtagtttaattccaatgtgtatagacatgagtctggttttatttatcttctgagtactttttgttttttttgtttttttttttttgagacagggtttcactcttgtcgcccaggctggagtgcagtgatgccatctctgctcactgcaacctcaacttcccaggctcaagcaatcctcccacctcagcctcccgagttgctggtagtacagacatgtgccaccatgtccagctaatttttgtattttttgtagagatgtggtttcacgatgttgcccaggctggtctccaacttctgagctcaagtgaaacacccgcctcagcttcccaaagtggtgggattactggtgtgagccactgcgctcaacctcttctaagtactttatgcccttcctgcatccaggaattcgagtcttatatcattcttgaaaaaatttaagctttgtctctttggatattgctttccactattctctcttttatctcattctcttatactatgttgaacttgtccattctagggtctgtacgtcttagcctttcttccaaattttccgttttttaagtcttcatattagatgctagtaatttcttcagctcttcttcaggtttattattctcgtcaactgtatctaatccactgtttacctatttattacgtttattttatttcagtgactattttcatttctaggacttccgtttgatttttaaaaacttttgtgtttgttgatttttttaggtctttaataattttaaacatgcttatttcatagagtggatctgattgttgttagggatctattgttctgtttgttgggatttctgagttactcataatagacagtttactcatttggtttatattattggattgtgagttcatattcagcaagattttatgtttaagaattatatctgccaaatttgagcatgtgtcctccagagtagatttgaatttgttttgcttcctagaggcaactaaccttgggtcagtgttaatgccggtttcttggcttgggaacttttcaaccacagaagcggtgtgcatttgaatcccaaatgttgagactatgtgatgtaatgttacgaatttctacaggaacaatatttttcattcatcacacattagtcaagatagatgaaatgtcttgtccgtctctgctttgtggcagatttttataatgtaccgtttttcttacagtatacgttttaaggcaaaaggtatgtatatagggcagcctttgtcttcaaactcgccccctcatgtaagctaaggataaggtcttttcttttgttcttacctcatataagcataaggtactcgcttttgtgtatgttaaaatttgagtacctaggaaatgaaaaccaacaattccccaaccctactcatctctaatgcttattatcctgattctcaagcatttcttgattactgacctctaagaatctctctttgtaaaaaagttcttttatatgtttatacaaataattgttatattttatctagctttttttttttttttttttttttttttgcttttgagaccgagtcttgctctgtcgcccaggctggagtgcagtggcgcaatcttggcttactgcaagctccgcctcccgggttcacaccattctcctgcctcagcctcctgagtagctgggactgcaggcatccaccaccatgcctggctaatttttttgtgtttttagtagagatggggtttcactgtgttagacagggtgtttgtctagcattttaagagtttgtaatggaagggttttcaagtcatttaatctcagtattgctaaaatgtaagtttatcctaattattcagaattggaaatgtagtctagaaaatccaaaatattaactggtattctactttaggaatgttcatgttttggataagttcttctaaaacatgtaaagggctaatattcttttacttcaaagtaccttacaacatgcatacccaggatttttctagttacctgttttattttttcttccacttttttacagagatagggtcttgctgtgttgcccaggcttgtctcaaactcctgggcccaagtgattctcccacattggcttcccaaagtgctgggattacagatgtcagctcccatgcctggttttaattacctgttttctaattaaacctaacctgctataacaagtactcaactttttttctctattggaactttagattttgaaggatatacctcttcttttatagttttttaaattagtaagtagtttgttgtacattattgacgtgtattttcttaggtttctattaaggagtttgaacataatctccaggcttctcatagtgttggcctaaatatcaggagctttttccccccatctcattgtacaattttgacggtttcatttttttttttttacacgtataggtttgacaggtaattatcaataatgagtgttctaaaccaaatattcagtttgttcttaattggtatgatggtttaaattaaattgttcctctcaatgtcatcagttaagtaacactataataaaagttctatagtgttatgaaatcctgaaaactattaatgtggggataatatacaatttaacatatatacaaggattattattatttttcagataatgacaaagatgtgtttatgagataataatgtctattgtgtatcttaagtaactatttaaaatattttatttctaatataggagattaataaaaatgtaaatttcttcaggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagttagtatgttttacttttgttcaaattaatgtggtaaataacacatataataaaaccatttttaaagagaaaatatttttctaaaaacagtgaacaatcacatttctatcctagtatgggacaggacaacataaatagtcaaaatccataaattattcataagttattagttctaattttcttgtattttattagagatgccgctaagtaggaaattaagtggtctccccagtagaataacaaaggtcgtaagtagagaatttagatcattgcttactatagtatatgtataatcatgactagaatatgtgtaaaaaaattttcaactttagtggtaataagtgcaatacaaatttaaaataaggatgagatacttttttttcttgtcaaattagcaaagatcaaaagaaaaatagtactctgtaccataaataatgcagtgagatgggcattctaagacattaataggaatataaattggtgtaacctttctgttcaggaagtttacaggtgtgcacctagagccttaaaaaatggttagaggttttgattgagcaacttcagtctaggaatctaccctatgacattctcagtagaacaaagatatatgtacaaggatacctattctaacgttatttatgatcacagaacactagaagcaacacagacacacaacaagaacaaattaatgaaacgttaatatatttagtactaagtgaaatagactgttcataataataagaagaaaggttttattagcagtcttagaagattgtgagcagttgcaaatacttagaatatgaatatccgatagaagggaatgataatctattctttttaatttgttctagtgaagcaattatgattagttgctttacatgtataaaaatcagttttatagggtttatattcttcttcctgtttgcaaagataatgtttcatatagttataaagagttgaaagactggaaatagcagcagggttgtaaatagcatgtacatcatttgaattagaaaaaaatattgtagtatatatttaacagcacagattacagcttcagttcaaattctggttctgccacttcctagatgtgtaatgttgagaaagttacttgaattctgtgtgtctttatttcttctataatattagcatagtaggagtacccacctaaaatgactgttttgagggttaaatgagtaacgtactttaaatagtgtcagatacatattatgtcctttaaaaatatttattattagttaatcattagtatgtaacttatatgaccattatcaatcatctatcttgatttaaatagagtcaaattccactactttgaagtaatttctcttcattctgatagcagtttaagatatctaaggtacaatgtattcttctttctatagcgcatgcatgattgagtcatatatgaaattaaaagtcctaggaaaatgatcttctgtcattcatccctgtattcctttagtattagtactttgcaccaacatgcagttattagatatatttaaaaataaaatgtatttttaagaaaaataaataagtcaaccaactacttagtatgttaaacactgatttatattttgtttctgtttttctctgtttaggagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgtaagtatgacactgtgaagaagttctgtccctctgtttctttctactatggttatatagtaattttttggtttataagtattttgctaggatgattttacaatgatcagttattagtcagtgatcatggcttccggtgcttattctgtcacaaatcaaattaagaagaaagttaactgaggtgaacatagttatttgtgactaagaacaaaattaaaattcaaagttttacctcttagataagttatgccattaagcttcgtaagagaacaaattagatatttaaaaaagcagattttatgattgtaaagtgcagaggttggcaaatttctccctaaaaccataaaactggacaaaattatcaaaatcaaccatgtcagggcctgatacaacaattgaagagaaataaattgagaagcatttatttgtgaaaaactgcttaactttagtttaaagtcacatataccacacacgtccatccccactactgacttggtctgggacagtagtactagtagcatggaactggatagaaaaatcagcagctttgctgatacagagggcagattccaggactaaatacccaagcccagtgtgttgctgctaacaatagcaaacttggtaggaaatcaatagggaaaatagtccacagacgtggtatagctctgaggtatagccctgcctgaggtgaatacagacctcaagccaattattcggccagtccaatagccaaataattcaaccattcttaacttgtgagccatgccaaaacaggccaacatagtatattgacctctgctataaccctttaggttatatgagattaaaatttaggaaaataagaacttaaaatttttgagttttttgcctttttagccttcctcttttttttttttttttttttttttttttttgaaaaaaaattttgctttttctcccaaggtggaggggtggggcacaatctcgggcttattgcaagctcccccttccgggttcacgccgttctcctgcctcaacctcctgagtagctggaactgtaggcgtgcgccaccacacctgggtaacttttatgtttttagtagagacggggtttcaccgtgttagccagaatggtcttgatctcctgaccttgtgatccgccctcctcagcctcccaaagtgctgggattataggcatgagccactgctcccggcccctttttagccttcttaatttgagcttttatttttattcagttattttatttactatggctttaatcctgtactaaaaatttttatgttaatgttatatgacttaacaaaatctttatttttaatttttgtgggtacataataggtacacgttatataacttttcactgaaacagtgaatactatttcaatacaataagctgtgatcactgtttgataactgataattgtaaaaccatcctagtactgtattcaaggcagataaaaatttctcatactttcctgtctaaacttcacaaagaataattaaactgacttctcttaccaattttttataaatagaattatatttactgttaacaaattatgaatcattccaaattaaatacatagtacagttgatcctaattattcatggtggttatgttctatatagttgccttgaacactgttagctaatattgaaccaatgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaaattaccacaagtattgatttggggtttacaaataaatattagcttctacacaaatttgcaaatacagaatacatgaataataatgactgtattctcaatatcagactttgaatcttcattttactttaattagaattttagagtagcagtgttcatggtctaaattttatatcactaaacaactataccaaacttaccagtgttttaaaattgaacagtcacaatttttttttaaatatttctttttggcattttatatttatagccaagcctacagatcatatagctatctatttcttaccagatgttttttcctcctttaggaaacgatgcccccaccaacacatactgcattttctggccaccatctgccatttgttggttttacatatactagtagctggtaagtttgaaaagttaacatagtttgggccaagtgcagtggctcacgcctgtaatcccaacactttgggaggccaagacaggtgtatcatgaggtcaggagatcgagaccagcctggccaatatggtgaaaccccatctctactaaaaatacaaaacttaggtgggcgtggtggcaggtgcctgtaatcccagctactcgggaggccgaggcaggagaatcacttgaacctgggaggtggaggttgcagtgagccgagactgcgccattgcagtgcagcctgggtgacagagcgagactctgtcttaaaaaaaaaaaaagttaacatagtttggacaatttaaagcaaattaaattgaattgaggttcgtaaaaggtgtatgagaaaactttgtgaattaaaactttttaaaaaatagaatgagcctactgctggaaatagaaagttaagcattacaaaatgaatagaacgcatgaaaatcttaactcgttttggaggggaaagaatggaacagagagctcagaatctaatccttaccaatgaagcagtaattagaagagtttcacgctgttgaatattctctagatgtcaagcaggagaactttcaacccattaattctaccatcctttcactgaccctcacttcacttatattccctatttcccccttaccctgtttaaattccattgagaatgattataatcactccttgtatgccatttcagttcctttgactgtctctcattctgttatatttgttttgctaagtgaacattaactattacaattttattctctacctgtacagttccaaatgactagaaaaaatagctgactattcttactggtctactttaaattcatgattaccaacctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccctgcctcagcctcctgagtagctgggacaataggcacaagccaccatgcccagctaatttttaaaacgatttagaaatggagtcttgctgtgctgtctaggctggagtgcagtggcacagtccatagataactacagcctcctactcctcaagccgtcctctggccttaacctcccctgttgctgggattacagatgtgagccactgcatctggcctatttctttctacttgagtttgaaacctctgtcatcctcactttcagcttgcatctcctttcactgaaaggattgaggcaaaccgcagacaacttccacaagctccagttaccatatttaccgcctacttattgttggacccaaattctctgttcttttcatggatgaactgtgcaagcctctagtaaggccagtatcttccatcccttcctggctagtctagtgcatgttttgctttcatgtcatgaatttttttcttcttgtgtcatctgcatcatcagatcatttctatcagcttacaaatgtcagttctccatcttaatgcaaaatataaaatctggattcctcttcctttacctcttatcaaccatgtctctgctttacattatagaaaatttacttcaactgttgactatattttgtttatgtttctcatactgttgtttcttgaatccattccagtcaggtgtgtgcccccatcacttcatgcaaactacttttatcgatgtcactgttgaccaacatgttgctaaatctaatgatcacttgtcagtcctagtcttacttatttgcttagtctcatcttatttgccacagctccatacttttaaaataccaccttctcctgtcttctaaggcacttgactgagtttctctcaccttgctggtcattccttctcagtctccatacctgatccctcctgatttccctggcttgttaatatcagagtgtcctatggctcagtctttggacttctcttttccatctaaactctgtagtgttctcccaaagatttgctgatgactcctaaacgtgcatctccaactgagacctctcctctcgtctactgtaaaaatctgtcttaaccacccacttactatgtaaataactttcttttagttctctgatcctgttcaggtgatcctcttaaaagataatcagaacatgtcactcccctgttcagaaccagtccacccatccccaactccagtggcttcatattttaactccaaatcaaacttcttacaaggccctacatgactgccttacttttatctttctgagtttatttttccttgtttactcaactccatccacacaggcctcctttctgggctgtgaacatgccagacatactcttgtctcggggctttagtacttctgtttcatctgcttggaacattctttcttttgatattcccttaactggtcccctcacccttacttagctttttccaaagttactttagcagtgacagctttcctaacttctttatctaaatttttatctcctcctcttcaatactttatttctccctttcctgctttatgttttctccttagcatttaacattttctaatgtaatgaatatctccattattttctttatttctgtctcagtcactggaatataagctctatatgggcaaggatttttgtctgttttgttcaccaccaaatgtccagcagtttcagcatttttatttaaattgtattgaattaaagacagaaacttgcttttgaatttcaaattctagtaaagagggccgtggttggtgctttgactactactgtttcacctannnnnnnnnnnnnnnnnnnntactgtttccctaggtggtcaaattgttttaaactaccagtaacccttcagcaaacttcattttataatttgtggggtttttaaaatcataataatttgggggattttaggttttcattttttaaaatgcttctaaaaacagtttatggtgattttgcaaacaaatttttataattattccagctggctaactgcaagatattcagatctgtgttttaaatgagcaatttaaaaatgtttttgccataaatgtggagtcagttaaaaacaatttttaaaaaatgttaacgtttttcttcaagctttttatcacagtatgaacctacatttttttttcttttcttcagtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaaggtaaatatattttaaatatattttcactttttgaattgtactcacagtgttatgagctgtttattataagtggttgttttatctttgaaaaaaattattttaagtggtgaaaaatcaagttgtagagatgtatgcagaacacagcataataccatttatgtaaaatcacacagttaatagtaaacaacaacaaaatagctttggtctcctgtgggtacatatttatgtttataaaaatgtgtgggaatacctttggggatggggaaatgggaccctcctcacttcgttatagcactttaatgacttttcctatattatttgctcaatctttaagagctctagctcctttcacactgtcattctctgcagcattgcttctgccatatttggtgattttaaaatgcacatacacataaactttttaagattctgagtgagtttcttgagtcttcaccttcagtgattgtttactccacctggtttcatccagtccatcctatggtaataagatatgtcttaagattacaatacctaaaactcttctttaatcgcagtttccagcaaatcttttataatctcctgctcataatttttagtgctctctctctgaccccttaactccagtatttcttcactgccaccgttacctacaagtctatcaccgtttaactctgctatttataccctcatttttcgttctctggtcagccatagtcataccctggcatataccttcaaatctattgttcctctttctctttgtcaaatacctttggcagaaccccaactgtgtttgaatacaactttgtatcttcaactatccagctgaagacagcttgcttaaaacacccacaacgtgctgactaatattaattcagattcacagacactcacctcaagtcagctcttcatgctatttcccctagtctatttccctatcctgtgttgtaaaatccagtgatgatttctgtcttcaccttttaacctatcagcaatatttgaccctatggaccttttattccttctgataacgctctctttttttttttttggcttctggggcactttatctcctggttttctttttcctcataaacctgtccttcccagtctcctttgctaagttttccttaactcttcgacctttgaatgttagaatattctctatttgaagcaagtctctaattgaatgaggccttcagtgaaggttttcctgaccatcctatttataatttaatcatatatatatccccagtactactgtctcctttttctgcttttttctctaaaataaaggatgtaacatattttacttacatattttgtgaatgaaggaatgtatttatggacaaataatcaggaacttttgtaactaatcagagttttacaatcacaaaactttactgtcatacttttagaggcccagtagagaaaaaggctgtgtagacatcaatagaatggactattttctgtttttccgtaagttgttaagatctctgcatatgaattacttcccttttgtgactgaaatttttctgtttcttttttttcctgtggtgatacacatatagcaaagtgtgcaagcattctacttttaagtataagcctaataaatatttgtatatgtatacactgatgtaaccttcacccatattcatgtgtagaatttgtccagcatagggtaaagtcctcacatgtcccttcccagtttgtaacctaccactatgaaataaacatcatcctaagttctttcaccattaatgaatttttaccggtttttgatcttcatataaatggtatcatacagtatattctcttttgtgtatggcatctttcacttgttttttgaaattcacccatgttttgtatatatcagcagtttgctcttttttttttttgtactgctgtttagtatttcattgtatatcagcaataaaaaattacccagtctgttgttggtaaatatttgggttatttccagatgttgactactgtgagtaaagttcgtgcaaatatacttatctatttattttggtggtcctatgtactatttctctcagatatatacctgggagtacaatttctgggccatatagtagaggattttcagctttagaagatattttcaaagagttttctaaagtgactataccaatatatagttctactaataatgtatgagttctactgtcttcaactcctcaccagaacttatcgtccgcgtttttcacttgtagccattctggtagaagtatagtgatgtcctgccgtgattttaatttgcatttccctgatgaataatgaggttgaatatcttttcatgtatttactatccatttggatatctagtcttgtgaagttttggttcgaggttcttgcccatttttctattaggtctttatatatctttttcttaataatttgtatgttactacttcacaaacaacgtagaaacctttagacaactccttgtatgactgttgttacatagtttactttaatctgtgttataaatcttttaatacacttttactccattgttgctttatgttttctttactcattaattttaagtatctttttatttacccatatatttacccttttggtgctttttatttctccctagtgatccatgtttctatctggaatcatttttctttagcctaaaaaacttcctttattgttttcttgtaatgtgaatgtgttgtgacaaattcttgataggattttgttgatctgaaaatgtctttatttttaccttcatttttgaagaatacttgtgctgggttagaattctagcttggcagctttttctttcagagctctactgtattatttcattgttttctataataacttcccataatatttcttgagaagccagctgttaatcttaagctcttgaatgtaatgtgtatgttttcccttctggctgctttcagtattatgtccttaacttcaatttcaaatagttggactgtgattcacgtacgtgtcgctttctttatgtgaacagaaaatcctggttgagattcattgagcttttgcaattttctttgatgtcttttatcagttttgcaaaattctaagccataatctctgtagatattattttgcctcatgcactttctcctctccttctgggactgtaattgtgtatatgttagatggtatctcacatttcctttatgctctgttctgttccttccgttctttctgttttttgtgtgcttcattaagatattttctattgatctgccttcaggttcactagttctggcttctgctttatccattttgctgttaagtccatctaattagtcttaatttcagatattgtcttttttagttaaggattattcatttgattctctcagtttcagttttctgttgaaatttccccatatttttatgtatttttttctctgttttctttaacattttaatattttgaggtccttatctgttactttcaacaactgaatcttctgcgagcctgcctttctgtttttttctttcatttgtcatgcttttctgcttttccaaatgtctcatgtgaaagatgtcatgaataaaaataacacagagaaggaagtttatattatttttgccccagagaggtttctcccttttcattccatcaagaattgagcttggacaagactaaattgctttttttttttttttttggagacagagtctcgctctgtcgcccaggctggagtgcagtggtgtgatctcggttcactgcaacctccgcctcccaggttcaagcaattctcctgcctcagcctcctgagtaactgggactacaggcacgtgccaccatgcctggctaattttttgtatttttagtagagacaaggtttcaccatgtaagccaggatagtctcgatctcctgacctcgtgatccgcccgtctcagcctccctaagtgctgggattacaggcaagagccactgtgcctgcccctaaattgcatttttaattagactcaaccctacctttgatttcaaatgcccagaatcgggagctggatagagcctagttgggcctctttctccttcacttcctaaactatgggagatttattctgttcttcagccttctgccctataccatttccaaatttggtgtcttgatgaagagactggccatgtatttgaagcagattctcttcctcaagcagctctttgtctctgaaataattctgtactatcggagatttctgtctgacttttcaaagctccctaacttcccatgcagcccccaagtacatcaattaaaatataccatgggaataaaagcaccatatgcttagggactttgagatttccaaattgttgcaccatccccacacatcctccagaagcttcagtggtttttctttccagcatgttatctctcaatttaaaggccaggcttgacctaagtacactcacagaaatggataaggcttccaggtaagaagcagttgtaatagcctcttcacctcagaatgcctcacttccctggctcactttcccaactccaactgaaaaagcaaagagaactaagtaaaataaaccaaagatgtttttaaaaataagattttctcaaattatgtattgaatttttactttctacggcaggagaaacaaagcagtgacctgttgcttcctagtccatccccttatgactaagaatttcctatgttttgggttttttttaaatgttttgaattctttaatttgttcttggtatttttacatgtgtagtatcgtttgcacagagcaaagtgaacaaaaatgtaagatcattgccttttggtatgaatacttgtttcatagcagtgacatagattaacatttaaactgattcattcatttattagctgtttattgagtatcaaacagcccaggagctgtactgcccatgaccaggaatgtaataaaaagcagataaaggcaaaaatacctccccttgttatgtttgcattctgttttgaggagacagacaataaatcacatacaaagtagggtcatccactgagagttaggaaggtagaggagatattagatatttgacaagaaaaagagaaaatgtgaaatggtcagtatggagacgaaaagagtaaatgagctagggaaatagtttaggatcgccagatatttccaagttatttaagttcagtaatcatgagttttaaatgactgtgtatttttttcagccattttcagctacttgggtaaaatcatacagtaggaggagagtagaaattatccaagatagagggccttctagaataagtacaatggaggagagaagggtaaagaaattgaaggtatttgcaaaacagtgatggaccaaagaatctaaccagggtaagtaagaaagtaaagaggaaaaaaatggaaaatgttaggaacacattgattggcatttctggttggaatgaaaaattgttgaagtggtccctagagtagtaagctgtacagatgagagagatgattttggaggccatgcagttattgataatgacaaagtgtatagttgaatttcttttttatttatttatttatttatttattcatttatttttttattgatcattcttgggtgtttctcgcagagggggattgggcagggtcataggacaatagtggagggaatgtcagcagataaacaagtgaacaaaggtctctggttttcctaggcagaggaccctgcggccttccgcagtgtttgtgtccctgggtacttaagattagggagtggtgatgactctcaacgagcatgctgccttcaagcatctgtttaacaaagcacatcttgcaccgcccttaatccatttaaccctgagtggacacagcacatgtttcagagagcacagggttgggggtaaggtcacagatcaataggatcccaaggcagaagaatttttcttagtacagaacaaaatgaaaagtctcccatgtctacttctctctacacagacacggcaaccatccgatttctcaatcttttccccacccttcccccctttctattccacaaaaccgccattgtcatcatggcccgttctcaatgagctgttgggtacacctcccagatggggtcgtggccgggcagaggggctcctcacttcccagtaggggcggccgggcagaagcgcccctcacctcccggatggggcagctggccaggccgggggctgtccgcccccacctcctcccggactgggcggctggccgggcagaggggctcctcacttcccagtaggggcggccgggcagaggcgcccctcacctcccagacggggcagctggccgggcgggggggctgacccccccacctccctcccagacggggcagccggccaggcagaggggttcctcagttcccagtaggggtggccgggcagaggtgcccctcgcctcccggacagggcggctggccgggcggggggctgacccccccacctccctcccggacggggcggctggcctggtggggggctgacccccacctccctcccggacggggtggctgccgggcggagatgctcctcacttcccagacggggtggctgccggacggcggggctcctcacttctcagacagggcggctgccgggcggaggggctcctcacctctcagtcggggcggttgccaggcagagggtctccttacttctcagacggggcggccgggcagagacgctcctcacctcccagacggggttgcggccgggcagaggcgctcctcacatcccagacggggcggcggggcagaggcgctctccacatcccagacgatgggcgggcgggcagagacgctcctcacttcctagatgggatggtggtggggaagaggcgctcctcacttcctagatgggatggcggccgggcagagacgatcctcactttccagactgggcagccaggcagaggggctcctcacatcccagacgatgggcggccaggcagagacgctcctcacttcccagacggggtggcggccaggcagaggctgcaatctcggctctttgggaggccaaggcaggcggctgggaggtagatgttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggtgtggcggcgcgcctgaggcactcggcaggctgaggcaggagaatcaggcagggaggttgcagtgagccgagatggcagcagtacagtccagctttggctcggcatcagagggagaccgtggaaagagagggagaggaagaccgtggggagagggagagggagagggagagggttgaatttcttaattggtgaaccacaagcatttggggtgaggtaattttttcacatgagagagagtttcacactctgagatattgaacattctgagtttccagatgttaaatgcttgtagcagtctcctcatgtgctgtgtcaacaactgactcccgttctcctgtccccttacataaggtgatggtaccacctgcagtagagaaccactagtttaggatgtggccagttaatctgatggttatgctggagagaagtctatcagctagattgttttgggctgcagatgtgagaattcttaaataatatggatttattttctcacttaagtcagaagtaaatggtttcagtgccaattttagggtagcttccctattaatttcttggctttccttacatgattccacaatattgtaagcctcaactttcagatgtaaactttggaaggtaagacctcccttcatacaccagattcagttcttcatatatcatctgacagacataccaggcatttcatttatcacacggtgatgttccctgctaggacaaaaaggagctaagtagattcattggcagagtacaccaagaattccatcttcatatctgcacatatccagagacccagaaagtggaaagattcatttagtttcatacatctttcatttaatgggagattaaaacctctccctgaagccccctagtggacttcttctcaaggtaccatttaagttctaactaggtcacatacctaattcttgaccaacacttgcaatgtagaatggaattattatgattaacttaaaccagccagttttgactgggcccaccttacatgtgcacactgtagcctgataattgaatttggttcacaagacagaagagatgaatagatgtcgggtaaaaacaagcagtatctgccgtaggggatttatgtgcctcagaagtcagtgttagatggattatctattttgatgttaaagttactaagaataataagaagagtagtaatggaaagaacagcagagaacaacatgtaaaatccttatttaaaaaagagtaagatagggaagacaagtggataaccacataagcaggaaatggtcatttcagtagacctaggaattttgaggaaagaggtggcaataatgagcgaggatgcctgccccaccttcatacctgtggtaggtggggtacaggaggaaaagtagctcctattaatgtccatttggtattctttggtcttttgtttgtttgttttttttgagacagagtctcgatctatcacccaggctgggtgtagtggcatgatctcagctcactgcaacctctgcctcccaggttcaagcgtttctcctgcctcagcctcccgagtagctggtattacaggcatgcaccaccatgcgtggctaatttttgtatttttagtagagacggggtttcaccatgttggccaggctgatctcaaactcccaacctcaggtgattcatctgccttggcctcccaaagcgctgggattacaggcatgagccaccgcacctacacctcccctgcattgggtatttttatgtctccccattttctacccccaatttagatgtcttaaaaaataaaaacaatggatgttcttttcaaaataataaatacggaaaggaccagtttttagtatgttttgaacccaaagagaaagaaatgtataagaaatacttataggatgcagaaaatcaacatcagatgcacaatctagtatatcttatacctttaattcaaattaacaaatatttattgactgccaaacatatagggattatggtttacacacacacacacgtacatatgcacacacaaagtaatcagtaatgatttgcactaactcataaagaattatggtaagggagagacttattatgtgagaatccctccataaatagcagaatacctattttagaacaaagggcaatttcatttctgatgtaaaatggtaaaaaatgttttctttgttccatgtcttttgatgatatctgggaataagcctcaatagagttattgtttttttaaaaccttgtattttctaattagaagtgcaagataaattaatattttctattttaactaaatattttagctaaattgttgagccatggttacctgtagctgggcctcaactttcagacataaaatttggaaggccagcatttctgcatatgtatattaacatgcctaactctccatttgtaaaccagattcagttcttcgtatagcatctgactgacataccaggcttttgagttatcacatggtgatgttcctactaggagaaaaaggagctatgtagttgattcattggcagagtacgccaatagtatttaaaaccaaaaattattagaaggtggattcttttgtatatatatatatgcagtggattttttttttttttttttttttttttatgagatacagtctcactttgtctcccaggatggagtacagtgccatgatcaaggctcactaccacctcaacctccggggctcaagcaattctcccatctgagcctcctgagtagcgggacttcaggcatgtgccaccatgccctgccaatttttatatcttttgtagagaaagggtgtcattctgttgcccagtctggtctcatactcctgtactcaagtgatcctcccactttggcctcccaaagtgctgggattaccatgcctggtctgattttttatgacttaatttttgagtattcacatgctttttgtcagtgagtagatgttttgttctataaaattgtataagaatttctctccaaaaaaataatgttattagttttaagaatttagagtatggtgatatttttatttcttttatccttttttttaaagagtcaacacagactgtccaagctctgcagtattcaactgttgatggtccactaacagcaagcaaagatttagaaataaaaaacttaaaagaagaaattgaaaaactaagaaaacaagtaacaggtaaatatctgtgattcactgttaattcaatttaggaaatgtttaaaaaatggtttattcacacaaaaaacatctattgagaacctgtctgtgttatgtgatgtgagttgcatgctagtcagggaagggcaaataagaatgggttctgctctcaaggagttcacattttggtctgggaaacagataaacagttattgcaatacatatgaaaaggctatcaggaaaaataaatggaggtacgtggagagtacataggaggatcacctgacacagacttacgtgaacaaggatggcttttttggaaggcctattcattttggaatttgtctggcaaagcatatttgtgaggagaggaaaaggtgagttaggagtgaggaagaaggacactagagacaagcagagtgcatgtatacaggcatcaagaaaatttattttctttgttaatgcaattattttttcagtgtattactgagattaaaactaaatttgacaagtgttcgtatacctattattcatttattgcattttttcaataaatatattgagcacctactatgtagcaggtgttgttttaggctcttgggattcaacattaagcaaaacagactaaacaaaaattctttgctttggcctgggtaaaggacagaaaacagaaaccagtaaatatataactttgtaaatgatacaatatgttggaaggtaataagtgctttaaaaataagaatagaataaggagaattagtcagatgtgcaaaatgaggagttttatcattttaagtatagtgctccaggggtaggcctgactgagaaggtgacatgttagcaaaaatttaaagaaggcaagggggttagccatacagttatctgcaaagtatgtgttccaggcagaaggactagccggtgcaaaaactctaaaatcaaatgtgccccaggtgttcaagtaaaacagagagtactggatggctagagcagaatgagcaggcagggagaatggaaggaaatgagaactaaaggggtgaaatgggcttgttgcctgatcagtagagccttactgattgttgtaaggtctttggtttttactcagaatgaaatggcagtttttcgcagggtttagaggcattacatgatctgaataagcagagggatagggagagagagcagaaggtactattttaacgagaatggtgaggcctctccagaaaggtagttttaggcaaaaataagtgaaagagaagaaataatctaatgtagcatcttttataaaaatgactatttaaaatgccatattaatactttgtttatattaaatatatggagatcttagttttgagcataatttatgaatgctattttgtgtttttaagaggctctcctcctaagaaatatctatatatctaatctctgttactttatctttccaaaagtaagttattgtagattgggaacatgataagtgaatcatggagtttgctttggtaccaacaataacattaagagtgccactgaatgtctgtgttagagttgtatgacactaaaaaagcagtagaacagaagaccagctagaatggtcagtgattcgtcttcagagaagcgatatcgatttggaaaacttattcataagcatatctctcctctttttaatagtagaatgtggctttgaatggcagtagcttttgaaagcttgctaattaattttaaaactgccttgaaatagatggtattgatgtaaaatattcaaatcaacaatctagttgttatgtcattcactaaaatagttgtgagcttctttgttagctctatgtaagagctgaatttttaaatattaaaacgttttgctgtcattcacaataatgttctggcactatccaaaggaaacctttgttgatgtctaacccagtatatatagaataataataagtaatttcattttctgagcaattccaaatggtatcgtatttttaattttattgttcatgtgttta

SEQ ID NO: 14383 - DNA, 54950 bp, Human
  misc_feature (1)...(54950): n = A,T,C or G
taggttttgttttttgtttttttttaatctgctaggaagtcttaaaatagaatggagaaaatgaaagactttactgatgttatctggtaagtgttagaagaggcatacatgcatcggagactggaagggaataagggaatttggaaaaaacaggctgatttttttaaatgttttaattttcatgacttataggttgatgcttagaagatctgtgtgtaggccggacatggtggctcatgtctgtaatcccagcactttgggaggccgaggcaggcggatcacctgaagtcaggagtttgagaccagcctggcaaacatggtgaaaccccatctctactaaaaatacaaaaaaactagccaggcgtggtggtgcacgcctatagttccagctactcgggaggttgaggcaggagaattgcttgaacctgggaggtggaggttacagtgagctgagatcacaccattgcactccagcctaggcgacaagagtgaaactccatctcaaaaaaaaaaaaaaagaaaagaaaagaaagaaacagaaacaggccagtcattgggaaaattttccgtttatgagtcttgagtcagaaaattggtgaaatgccctttggaagctgagtcagtgcttatgactagttttaggatatgtctgtttctgagtttctaagatccttgctggatctttgaactttgaaaaatttctcttagtccagtgatagtttcacattgatatcaacttttattaaacatttaaaattttcctaactattgtaagtagatttgggttcagctaagtacatcagtgaatcggattggtgtgtaatgaaaccataagacatgggtcccaacttcagaatgcttcacatttggttgtggaaacaggtcacatgtatcatgttaagtaatggagataaaaagtttgcaattaactttttttagtgatttctttttttttattagtgaaatttaaaatctatttccccaaagtaatctttggagttcaacctaattttagtgataatatatgtgccagatttaatgctgtttctccttcccaccgctcccgcctccccaaccccaaccttccgtacattagttgaaagggccctgcaggaaggttctgaagtcccaggcaaatgtaatagggggtaggcagaggacttacttagagagatggtggtgaaagtctcaaactgcagatttctagaacaaacaggttacttgtaagaagcagacagagatacttagatcagtaaaatacttctgtaacactagaagtgagaagacatgagaacgttatctagaaactatcaagaggaaatgactgcagaccaaaaatcctacgcatagtagtcaaataaaaaatgtcaagggaaaaaaaaaatgtttggaaaggcaaggaataccaactatagacctcaaatgctgaagaatatacttgaggtattctcccaggttaaagtcaaagcatagcatagttctaaggacaaaagaagtcaatgagcgtcgaaaacaagtgcagtttgataatcaacttgttcagtattgcaagccctcacacctacatggacagagttaatcacagtctgtgttctgcctttgtgtctctttccacctcaccccagtctaaccccatccccatctcctacacgctgcttagctgtcatttcagtggactttcaggaaggaggggaggtaaaagcatgggatcagtctaacgtcttgatttggaaaatctgtttttaaaatactgtgcttcttaccacaaaaggttgctgtgaagagttgttggtcagggcttatactgcaaacaacagaaaccagcaatggaggatttaaacaaaaaagaaatctatggacaggattctgggtgattcctaggctcctggggaaggctggagaaccctgctcagttggttggaaattggacaaaatttacttcgcagtgacagcactgtatcttcacttagaaataaattgcctttttcttcttttttcaaacataggttatatatttggggagaaccccagaagaagcatatagaatattaatctttggagagacatcctatattcctttcaggtaaatataagaatgatgtggtagattcaggtaatcagatccttgccagaaatatcttgatagttgtttctgaaaaaagaagatctggtaaatagtcattttaggatgagcgcaaataacaccacagatctgggtttttccacagtgacactgttgacgttttgtcatggaggctatcttgtgcgtcgtagcatgtttagtggcctccgtggcttctgcccactagatgctggtaaaatccccacacccactctaattgtcaaaactcagaatgtcttcagacattgccatatatccctgtaagtgaccttgggggatggagagcaaaatctccctacgctgagaactactgccattgatgaaaactaagctttggctgggcacagtggctcatgcctgtaatcccagcatattggaatgccaaggtggaatgattgcgtgagcccaggagttccagaccagcctcggcaacaaagacagaccccatctctataaaaaaattttaaaaaaaattagccaggcgtggttgcacatgcctgtagtcccagctacttgggagactgaggctggaggattgtttgagcctaggagttcgagggtgcagtgagtgagctatggtcataccccagcactcaagcctgggcaatagagagataacttgttctcaaaaaaaaaaaaaaaaaaaaaaaaaaaaaaaaaaaaaagcaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtctcctttcatacctttgatatttatgctaagtaatccctacgtgtattttgttgtcgtcacttgttctcgcgtcaggatacgacctgcagctcgcttgtcgattctagaggatccgtttaaagacgtggtggaccgtttattctaacatttgtggaatattcattttccccttttaagttaatgtatatacttatagtttttaacaaaaacactaatctttttttattttattttatttttttgagatgggagtctcgctctgtcaccaggctggagtgcagtggcgtgcgatcttggctcattgcaacctctgcctcccaggttcaagtgattctccttcctcagcctcccgggtagctgggactacaggtgcgcgccaccatgcccggctaatttttatgtttttagtagagacaggggttcaccatgttggccaggatggtctcaatctcttgacctcgtgatccacctgcctcggcctcccaaagtgctgggattacaggcgtgagccaccacgcccggcctcaaaaacactaatcttaagtgtacagtagtaaggttttacatgtatttatgtaactaccacacagtaagaaatattacagtgtgaagacccaaataaggtggggaattagtgatagctccaccagcaaccctgtttccccaggagcaaatgagtaccattcagataggcacagtttttctgcatgcctagcttaatcataattaaattaatttttatgttgcctaattccagaagatttcatcttgtaatggctcaaggtagccaaaaaggagaagcagggtaggggtcggggtgccttatttctctgggtaaaaccttacttgatattaagagatttgtataggaagatttactggtatgtattgatgcagtgtttggctggagttgtctgtaaagtaatataagcactttcccaaaactagagtgatcctgtggaaggtagttgacttgttagttcctgtggttttattggtattactgtcctttaaaaatcagaaagaaggtagggcacagctgtttacacctgtaatctcaacacttcgggaggccaaaaaggtgagaagactgcttgaggctagaagttttttttttttttgagacgagtctcgagtctcgctctgtcacccaggctggagtgcaatggcgcaagctccgctcactgcaagctccgcctccgggttcacgccattctcctgcctcagcctcggagtagctgggactacaggtgccccccaccacgcccggctcatttttcgtatttttagtagagacagggtttcaccgtgttagccaggaagatctcgatctcctcaccttgtgatccacttgcctcggcctcgcaaagtggtgggattacaggcgttagccactgtgcccagccagttgtgtgggtgttttgggcttgttgttttttgttttttgttttttgagatagagtctcactttgtcgcccaggctggagtgcagtggcatgatctcggctcactgcaacctccatctctcttgttcaagcaattctctgccttagcctcctgagtagctgggattacaggcgcccaccaccgtgcctggctaatttttgtatttttagtagagacagggtttcatcatcttagccaggctggtcttgaactcctgacctcgtgatccacctgcctcggcctccctaagtgctgggattacatgcctgagccactgcgcccggcagaggccgggagtttaagaccagccttggtatcataatgagactccatctctaccttaaaaaaaaaaaaaaaagttagctagatgcggtgatacatgcctgtggtccttgctactggggacactgaggtgggaggatcacttaaacccaggagtttgaggctgcagtgagctgcactgcaccccaacatgggcaacagggcaagacgttatctctataaaaaagtttaaaaaaaaaacccagaagttacccagttaaatgggtaaaagtctttaggataacgatagcaacaaaatgcttatgaccttctacctaatattttaaatgtgaccttgatttctcagtatttctgtcatacttggttggagacacacacacacagacagacacacgtataaatagacacacatacacacatatgtttattacaggatcaaaaagcagtctttcccagtaagattttcatacggtattttccagtttaaagaaaaaattcaaatgctttgcccctttgggggagagataggtattgatttgttgaattcaagaaggtggctcagctgttaaagccaaaaataatccagagagaacatttgaaatttaggaagtggtcattattgatccaggcccataaaacagtacctattggaataggtagaaactgcagtgaaatttgtaattgatttatcttttatttaaaagtcaaaaggcgagatttttttcttcttgataatggttcagagtgtacatttgattttaaattctagtcacctttgtcttaggtaagtgtaattgcagaaaattaactgatctacattttattactcttgggtttcagagatgctgcctatggaagttgcaatttctacattacacttcttgactgttttcatgcagtaaagaaggtgagtgacatgtaggatgcacccagtgttgtgttgaggaactaacatgcggtccaagaaaactaggccttcttcccgagatctttttgttagtgtttcttccaagatgcctatggtgacagaggtgctccatttcccaactaatgtcagaatgagaccaaaccaggaaacagtttattctgaatttctgagtgcttctatgtatgagttgggggaaaagtcacttaagaaacagggaaaataagagttatacgattaggttctagatccagaattggttttgagtatattatgatctaaaagaacaaaagtaaagatgacttgtttactggtaagttctctttgatttgtatattctatatacctgattcctgccaataccattacaacagacgtaacacagtcactgtcaaacacttcatttttgttttgtcaggcgttcaatttctagttcaacagaatttgaatgcctcaattagtttgttatacagttttatgtgaaactaagtgggtcactgctgctttgtcaaactatttccaagtgattccttgggtcataaccagggctgctgtgttgattccaggggacaccctccctatcacgttctacgtgaacagggtcccctggggtcacacagtgcagcaagtcctggtattaatgtcaggacagcaggagaaactagaatggtaaatcagtagcccatggatcaaataagcctttgacagcatttttctgtaacttgtgcttttagagccaaaaggaacccaggtttactttcttgtataatgaaacatggtggcttgctgggaattgtgacagacatgtcttaaaacgagaggactaatcagcatacaaattcagagactaattgatatacttttttccctgtatcaatcaatgaggtatgggcacattgtttggatttgagcccagtgactgtgggatatggagctgattggggtagttgccatgagctctgaggcggctccatgggccctcagtgtgggcaggtatggggcactggtggaaatcaggagaccaaagggcaacaggtgtaaatggtaccttctggttgcagttgcagcccctgccaggtgggctcatgcaggcaggcacactcacctttaaaaagagaaaagtaaagctttgaggggtttggaaatgatctattataacaccatatggcagcttctattattattttttggcttttttttttttaattgggtattgcacccaaagtcaattagctggtacgataggtcaaagattgccatttgcatactatattttgggtttttttaaaattaaattttcattttttctgctatgctcagctaatttttatattttttgtggagatgaggtctcactatgttgcctaggctggtctcaaactcctgagctcaagcgatccactcaccttggcctcccaaagtgctgggattacaggcgtgcaccaccgcacccagccactatatttagttttatttaagggtcactatcttctgatttgcagtgtaagcattttttatttgtgactgattttgaatattgcatatatgaagaaacatgcatcaatgtaattatgttttcagtgtgattcacttccaataagatcacctcatgaaattcaaaggaaaataggaattccttataaactacttttttttattgtttcattctattagaaatagctgtagtccaaaatcatgaaatatattgcagtcaaggaaataaattttgtgattgacttagtcttgggattagtgtttaaataactatataaaatgaagacctttttagttgatattctagccttcttattttacatttgtatttcagtagtttacttttgaaaactgggtgtacaaaagccccctctttgaaccaagaataccttgtggatcagcaattcttgcttccctcctgtttggctcagggatcagcagccaggaggatatttctcagaggctgctaggtctgtttgtccttgtctcagaaaatagacactctgcttattttggttatcatactctgcctgctatcacacagagtaaggctataggataggacagaaattttttttgttttattcctatggaaagaatatcttttttttcctcaaaagttttgattttagtgttgatgtcagagctgtttactttagggaacattgattaaagactgttcggaagaatttgaaaatgaagatatggatgaagtatgagggttttgtttgggataaactagcacatggattctctcctctttcttatcgatgtagagaccattgggttgtgcattatatttgaatcctaaacttctgaattttcagccaggggtggtagtgatctggtaagagaagaggattactttcagggcgtgattatttaacaatacatggataggatgactggtgaatgaaaataaaaaagcacatctcacaaacaaaatccaaacaaaacacaacaaacttattacatatagttataattaatttccatataaaagaagcacttagaagacgccgcccacttcctttgaaagctgttcagtggaaagtaatctgatcatgacaatactttcttggggggcccctgatatttagtattctgaaattggataggaaactgttttcttatttgcatccttgttcttaaaagctttcttttggattttaggcaatgcagtatggcttccttaatttcaactcatttaaccttgatgaatatgaacactatgaagtaagtcttcaaggatcatgttttcaactcttcctccccccgcccagctttattgaggggaataattgacaaataaaacttatatatacttaagatgtacaaagtaatgttttgatatatgtatacaccatgaaatgattacctaatcaagctaattaacatattcatcacctcacataatttagtcttttggcgtgtgtgatgagaatacctgagatgtactctagcagatttcaagcatacagtacacacattagatctccagaatttacttatcctctgatggtttgtactctgaccaaaatttctctgcctgtttttaatttttctttttttaaattgaaaaaaaaagagagagaccaagtctcgctctgttacctaggctgaagtgcagtggtatacatggctcactgcagccttgaacttctgggattaaatgatcctctctcttcagcctcccaagtagctggaatcacaggtatgtaccaccatgccaggctaattttttaatttttatttttgtagagatggggtttcactttgttgcccaggctagagttgaactcctggcctcaagcacttctcccaccttggcctcccaaagtgctaggatcacagatgtgtgccactgtgcacggccctgtttttagctttcttaatcacccatttcacttacagaagcaatattcttgttttgttttagacgtgtatagagtgaaaaaaagtcaagtcttcatcttcttatccctatttctcctgtcccaattctcagtgggaatttctgcatttgatgcacaattctagagtgaatgagtgtgccccgtgtgttctttatactgtttagtttaaatgtattttagtattgatggctgtcacacagtgattgagatgcttttaaaacccttagcatagaataagatgagatgaatagtcattatacacctaattatctctggaaaatatctttgtttttgccataaccttcggtttgtcaggacacttctggttgcaagttacagaaagtaaacacaaatagcttaaataaaaaaggaaaaatctgccaggcgcagtggctcatgcctgtaatcctagcactttgggaggcctagaggggcagattgcctgagctcaggagtttgagatcagcctgggcaacatggtgaaacctcatctctaaaatacaaaaagttagccaggcgtggtggtgggcgcctgtagtcccagctactcaggaggctgaggcaggagaatcacttgaacccgggaggcagaggttgccgtgagccaagatcaccccactgcactccagcctgggtgacagagcaagattctgtctcaaaaaaaagggaaaaatttactggattacataaattaaaagtccaggaataggattggcttctagcatgccccttcaggtgctcagacacttaatcagaaattggacttgaagttagttttattctcaggccagccttctccagtagtgataaagatggccaccagcaactttgacctgccagtttggcaaaatgatcagaaaagtgtaatcttagctccatcagaaggcccaggaatgcctctcactggcctgacttacgtcatgtgcccatctctgcaccagcctgtgttctttggcagggcagggctaaggaatactctggccagccttagttctctggccatcccaggagcctggggcatagggtcagccccatcaaaccagccggaccaaaaaaaaatttattttctaacagttttattttattttatttttctttctttcttttttagagacagggtctcactctgctgcccaggctggagtgcagtggtgcgatcttggctcactgcattctctctcccaggttcaagtgatcctcccacctcagcctcccagtaacggggactacaggcacgtgccaccatgcccagctaattttgtaatttttttgtagagatgggatttcgccatgtttcccagcctggtcacaaactcctgcactcaagggatctacctgcctcagtctcccaaagtgctgggattacagatgtaagccacggcacccaaccacacaaaatttcttaaaaacataggacagggccagggagagataagccaggcaaaaccacaggtgtgttctatgttttttaacatagtatatatattttaaaaagaataaataatttgattctacagctttatcctccaaatagggaatgagtaagatactgtgctaaagcccttttcagcccagagtagttgtagcctcctgtcttcttaccctgctgtagttaccttgagcagacttgctccccagcactggggagatgattcctcaaacagcagcacttcatgtggcagcatcttgaatcctcagagaattctttttcacaacgtccaaagtaaatattatttcaaactcttacgtttaactgaactgttttttcaatttcagttaataatgacactcagttgtttctgtgatgtaccaaagatgtaagaatacattgtaggattcattagggccaaccctgtctttacttctctgatagcagtccatttctaaagtacaacgtacatttaactagcaccttaaacttacagaatatagctaagttattaacaccttttttgcgcttgtccttaaaacattaaacatttgaaacaagttactttgtctatgtaagcaaaactgctaaaaacactagttggtatttgttccttttgtagtgatgcctttgtgtgctattaatgaataatataggcactaagtaactcccctgttactactgtagagattggagggtctgggctggggggtagcaggggcacaccacaaacgtcttcacctccatgaagctgtgtggtgacacagggaactgtttaggttcccacacaccagttcagttattatagtgtatttagaaatttggggatagtgtcattcattgattctacaatgcccattttttcctatttcagctcctctgaattcaggatgtatcttaattaatggcatcagcaattcagtgaaatctagttgttgccaacaactgatcacgggtttgttatttaaaagtccagatttctgatttcactttaaaatcagaatatctggcaacagctgccctcattcctgctttgacctttccttttctttttatttaaagagagagggtctcactgtgttgccctggctggactcaaattcctgggcttaagtgatccttctgcctcagcctcccaagtagctaggactacaggtgcatgccactgcacccggctgtttagacctttgtattatggaacatgggctgactgattccccatgttgatcattaagtccagtaaactggtttgggattacctgcttggtccctgtagatattcaagaaactctgttattttttactcatttttaggtacacgtagaaacaccccaatttcaaagctaatttatctgttgtttttaatcacgagtcctctccttctgcactatcaagtgtcttctacttcctgcttaagtctctgttgtccatttcattaagacagaagtttctattattgttaaatttgaactgtatctatgttataatagtaatggtaactcaatccaaaggacctaataacaggaagtaacatgtcttacatatcagtttatatttgtttttttgtagggacatactgtgatcttggtatacttgtaattttttagtttcctggtcggttcagtgcatttatttatttattattttaatttttnnnnnnnnnnnnnnnnnnnnnnnnnnnnnnnnnnnnnnnnnnnnnnnnnnnnnnnnnnnnnnnnnnnnncaggctggagtgcaatggcacaatctcggctcactacaacttccgcctcctgggttcaagcaattctcctgcctcagcctcccgagtagctgggattacaggcatgcgccaccatgcctggctaattttgtagtttttagtagaggcaggatttctccatgttggtcaggctgatcacgaacaaatgaactttttaaattggttgccttattaaatagttaggaagatagtggaaagatatatctctgtaagtaggtaagtaagtaaatattgggaagccagaaacctaagtagatagtttttccccctttattcgtggagtcaagattgctcatgttggaagccagttagtcattcaggaaaacagggaagttcccagattccttatactggaaaagtttgcttgctttcttattaattagcagcaactataatgagaattgattcagataaaataaccaaatagtatatttgtatggcagcagtcagctctgtattccaagggctgataccctagcaatgaaacactgttaaaagaagatgattaggaacaggatatacgtccattccctagatatacttatagcagggcaaattgagattcctgtctcatggcaatttgtaaacagcttttccgctaaagcaaatgagtttgaagtccttcagagactcagtcttgagtagagaggttgtggggagaatacatttaaaaacgaattgtgctggtcttccccttgcagaaagcagaaaatggagatttaaattggataataccagaccgatttattgccttctgtggacctcattcaagagccagacttgaaagtggtatgtgaaattatggcattaatctcattttgttattgaaaatatctatcctatattttcttttgaaagagttacaccaagcttgaccaagtgttaattattatttaagcatacttggtcacttcagtagatcattctgactggattttaactttcttttcttttgttttttacagttataatcaaattggtatttaattcccagtccagatactgtttccgttcagttacaggtgaaactattagccattgttttctttatgtgttttataagatctggtgcatttctttatgtaggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaaggtatgtttctaggggtggttaaagaatagtatacagtatgagtatatgaatatgtagaaacagaccatattcatttagtttatgtgtcagaacatgaaactgcctttatttttagagtgccgtgaaacctttgatttcagatgaaaagtatagtaacttattttcataagtaattctacaaatacatcacattgaaatgcatttatttattcatcaaatatttattgggtgcatcctatataattctaggatacatcaatgagtagcgtagactgtaagagcctgtcttaatggaaactatattcttaacaagttgctctgttttcagcaattgtaacagtgcctggcacttaatagatattttttgaataaatgaatgactatacaataataaatggtatgaagatagtaggatttatttaactctcttgttagttaattaagaaacaagaaatatagttttgttacaaaaatccaatattggaaaaaaagctcagcaagccttggggaaagggggagactgatctccagagttactgctgtatttgtagttttaaatataatggcaaaacatcacatttcagtttttattgaaaaattacatggcatacaaagaaacaggaaagtatagcctattcaaagggaagaaataaatccaggccgggcatggtggctcacgcctataatcccagcactttgggaggccatggcgggcggatcgcctgaggtcaggagtttgagaccagcctggccaaaatagtgaaaccctgtctctactaaaaatacaaaaaaattagctgggtgtggtgacggatacctgtaatcccagctactttggaggctgaggcacaaaaatcacttgaacccggaaggcagaggttgcaatgagctgagatcatgccactgcactccagcctggccaatagacagaacaaaaaaaagaagaagaaataaatccacagaagctatccctgagaaagatcaaattgtggacttagtaggcaaaaaattttaaataaccatcttaaagatacccaagagttaaaagaatatgtgggaaaagtcaaggaaacgatttatgaagaaatactaatatcagttataaaaagaacacataaaagggaaccaaaaggaaattctggaaatgtactaaaactgagatgaaaaattcactggagggattcaaaagcatatttgagcaggcagaagaatcagtgcgtgtgaagctagaatcattaaagaattagcaagtctgaggaacagaaagaataaagagcataacataaatgaacagaatttaagggatccctgagacacacccaagtagaccaagatacagatcgtgggagttccagagggagaagagaagtaaaggagcagacagatgatttggctgaaaactccccagatttgatatatgcaggaatatccaagaagctcaacaaactccaagcaggataaactcagaggcccatgtgaacatgcattataatcaagctataatgccacagacagtcttgaaagcagcaagagagaagtgacctaccacatacaggggataccactgagattgtcagcagatctctcatcagaaacattgcaggccagaaggcagtgggttgatatattcaaaatgcataagtgagggaaaacctgttaagaattctacatctggcaaaactccttcaaaaataatggaaaaattaagactttgcccaggcaatcagtttgcctttctgataaaggcaaatacatggaccattataaaagctagtattatcgtaacgagataatttgtaaaatattattactgtaacttgtaaatattgtaacttgcaaaaaacaaatagaaaatctgaatagacccctaactagtaaggggattaagtagtccaaagcctcctgacaaagcaaaaccttggatataataacatcgccagtaaattctaccaaacacttaaaagggagtttttaatcactagatctgacttgcaagaaactctaaagggggagtcttttaggttgaaatgaaggcacactagacagtaacacacagccatttgagaagaggaaataaagatttctgataaaggcaaatacaaggaccactataaaagctagttttattgtaacaagataatttgtaaaatattattactgtaacttgttattgtaacttgcaaatattataatatgtaaattattgtaatttgtaaaataatttgtcgtttgcaagtagtataatttttgtgtattattatatacaaaaattgcaagtagtatattattgtaatttataaaatagagagtagaaaaccaatagagaaaatgaacaaaaccaagggttggttctttaagaagaataacaaaaatgataaacctttagctagaatgatgaagtataaaaggaagaagactcaaattactaaaattagaaatgaaaatggcattaccactgatactacagaaataaagctgatcagtacgtaaaaatgatcagtattgtaggacaacaaattggatagtctacatgaaatggacaaattcctagaaaaacaaaacaccagaactaaatcataaagaaatagaaaatctgaacagacccctaactaataaggagattaagtaatccaaaacctcctgagaaagcaaaaccctggacatgatagcatcaccagtaaattctaccaaacacttaaaaaactaaaaccagtccttctcaaactcttctgaaaatttgaggaaaaaggaacactttctaactcaataaggtcagcattaccctgataccaaaaacaaaaagacactataagataactaactataggccagtatcccttacgaacatcgatgtgaaaaccttgaacaaaatactagccaatggaattcagcagcatatttaaaaggattgtgtgccatgaccaagtaggatttatcccatgattacaagagtggttcaacatatgaaaatcaatcagtgtgatataccacgttaaggacaaaaaccatacgatcatctctgcacaaaaagcgtctgacaaaagtcattacccttttgtgataaaaacacagtacaaactaggtatagaaggagattacctcaacataagaaccgtatgtgaaaagcccacagctaacatcatactcaatggtgaaagactgaaagcttttcctctaagctcatgaagaagacaaggaggcttggttttgtggcttctatttaacatggtaatggaagttctagccaaaggaagtaagcaaaaaaaaaaaaaatcgaaattagacagggggaagtaaaattatctttttgcagatgatatgacttatatgtattatagaaaaccctgggccaggtgcaatggctcttggctgtaatcctagcactttgggaggccgaggtgggtagattgcctgagctcagaagtttgagaccagcctgggcaacacggtgaaaccccgcctctactaaaataccaaaaaaaaaaaaaaaaaaaattagccgggcgtggcgcatgctaaggcaggagaattgcgtgaatctgggaggtggaggttgcagtgagctgagatctcgccactgcactccagcctgggggacagagcaagactctgtctccaaaaaaaaaaaaacagagagagaaccctcaagattacgcacacacacacagagcccctgctagaattaataaatgagttcagcaaagaagtagcagcatatacaatcaacaggcaaaaatcccttgtttctaagccctgacaataaaaatataaaaaagaaactaagaatacagtttcatttataatagcatcaagaagaatcaaatattggggaattaaccaaggagatgaaagatttgtataaaacatttttgaggaaaattaaagaagatgtaattaaatgtaatgacatcacatttgtgcactgggtgacttaatattgttaacatgtcagtattgcccgaagggatatacagattcaatgcaagcctgtcaaaatttcaacatttcttgcaaaaatagaaaaatgattctgaaattcatttggaatctcaagggatgccaaatggccaaaacaatcttgagaaagaataaaaaggttggaggactcacttcctggtttaaaacttcatacaggctgggcatggtagcttaacacctgtaatcccagtactttgggaggctgagacagaaggattgcttgagcccaggagtttaagaccaccctggacagcatggcaaaaccccatctctactaaaaaatacaaaaattaactgggtgtggtggtgtttacctgtagtcccagctactcgggaagcttagatagcaggatcccttgaacctgcgaggttgaggcggcagtgagccatgattgtgccattgcattccagcctgggtgacgtagtgagatcccgtctcaaaaaaaaaaaaaaaaaaaggcttagtacaaagctacatcaatcaagattgtgtggtactggcataaagacagatacatagaccagtgataggatagagagctcagaaataaatccttgtgtatatggtcaaatgacattcaagaaggatacagaaaccactcaatggggaaaggacagtcttttcaacaaatggtgctgggaaaacctgatatccacatgtaaaagaatgaaattgggcccttacataacaccatatacaaaaattaaaatggatcaaggacctaaatataggacttaaaactataaaactcttagaggaaaacagagggtgaaaacttcatgacattagatttggcagtaatatgacaccaaaggcactgacaatgaaagaacagacaaatcggactatataaaattttaaaacttttgtgcatcaaagtatactatcagcagagtaacaaggtaacccatggattgggagaaaatatttgcaaatcacttctgataagggattaacatccagaagatatagagaaaacgcctaaaaacaacaacaaaacccagttcataaatgggaagaggacttgaatacacctttctccaaagatataaaatggccagtgagcacaagtaaagttctcagcatttttgacttatagggaaagtcaaatcacaaccacagtgagataccactttatacccattgggatggctgttatctaaaagaacaaaaacatcaccaccagaaaattacaagtgtggagatgtggagaaaattagaagccttgtgtactgctagtgggagtataaaacaatgcagctgctatggaaaatggtgtggcagttcctgaaaaaattaacgtcattcagcagttccatctctggttatatgctcagaaacaattgacagcagggatatgaacagatatttttacacccatgttgtagcagcattcttcttcttcttctttttttttcttttttttgagatggactttcactctgtttcccagactagagtgctgtggtgcaatcttggctcactgcaacctctgccacctgggttcaagtgattctcctgcctcagcctccagagtagctgggatgacaggcacgcaccatgacatccagctaatttttgtatttttagtagaaacagggtttcaccatgttggccaggctggtctcgaactcctgacctcaagtagtccacccgccttggcctcccaaagttctgagattacaggtgtgagccaccacgcccggccagcagcattactctgaatagccaaaaggtggaagcaatccaggtttccatcagaggaaggctaaagaaatggctaaagaaaatgtgctatatcatacaacagaatattatgcatctttagaaatgaagaaaattctgacacatgtactgccacatggatgaaccttaaagatattaggccaatttaggtttgccagtcagaaaaggacagatattgtatgaatccagttgtatgagatacttggggtaagagaaagtagattggtggttgccagggcctgaggggaggcagggattggtagttattgtttaatgggtccagagttggctgggcacggtggctcacgcctgtaatcccagcactttgggaggctgaggtggccgcctcacgaggtcaggagatcaagaccatcctggctaacacggtgataccccatctctactaaaaatacaaagaattagccaggcttggtggtgggcgcctgtagtcccagttactcgggagtctgaggcaggagaagggcgtgaacccgggaggtggagcttgcggtgagctgagattgcgccattgcactccggcctgggcgacagagcaagactccatctcaaaaaaataaataaataaaaataataaannnnnnnnnnnnnnnnnnnntggatggtggtaatgtttgtacaacaatgtgaatgtacttaatgctactgagctgtacacataaaaagtggttaaaatgatattcagaaacttacactaaggaaatacaagtttccgaattaaccaatacagaatttttttgtttttgtttttgagacggagtcttgctctgtcgcctaggctggagtgcagtggcacgatctcagctcactgcaacctctgcctcccaggttcacgccattctcctgcctcagcctccccagtagctgggactacaggcgcccgccaccgcgcccggctaattttttgtatttttactagagacggggtttcactgtgttagccaggatggtcttgatctcttgtgatccacctgcctcggcctcccaaagtgctgggattacaggtgtaagccaccgcacccggccccaatacagaatttaaaataactgtcttaaacatgttcagtgagctaaaacagaattcagacaactaaatgaaatcaggaaaatgatgcctgaagaaaaatggtaaattttatgtatattttactccaatttttaaacataattaaaacaaaagccagcattgcttatttcattttttaattataaaaagcagttgaaggaattcttcagcaaggtccttttgcaccccaaccccatcacacacccgacatttggcaacctgcagagaccttttttgggggttgggtaccacgggcatctggtgggtagagatcagcgatgctgctaaacatcctacagcgcacaggacagctcctcactataaataattatccagcctcaaatgttagtactgctgaggttgagataccctgaaatagaatgatgaccaattaaaagcctagagaggatcttatttgattgcatctttgtttagggaagaaaaatgatgacagtatgaaaattgggctgtacagtgaaaattgagattcattaagaggtatattaatctgctggggcatatcaccaactgggtggcttaaacaacagaagttaattctctcacagttctggaggctagaagtctaagggcaaggcactggcagggatgttttctggggaggcctctctcctcggcttgcagtgcagatgtctgtcatctctgagtcttctcatggtttgcacttaactcctgccgtctctttcttttatttttttgagatggagtctcgctctgtctcccaggctggagtaaagtggcgcgatctcagctcactgcaagctccgcctcccgggttcacgccattctcctgcctcagcctcccgagtagctgggactacaggtgcctgccaccacgcccggctaattttttgtattttttagtagagacagggtttcactgtgttagccaggatggtctcaatctcctgacctcatgatctgccctcctcggcctcccaaactgctgggattacaggtgtgagccaccgcacccggcctatctcttttttttcttagaagtacaacagtcctattggattagggccccactctgtgaccttatttatttccgtaaaggccttatctgcaaatacagttgtattgggacttagaacaatatatggatttgggttaggggggacacaattcagttcattatattctgccatctggcccccctcaaatttatgtcccttcacttcaaaaatacattcaccccatctcaacagttctgaacatctcaattcattccggcatcaactccaagttcagagtctcatctaaatagcatccaactcaggtataggggagacttgaggtatgatccatcctgaggcataattcctcccagctgtgatgggatggtacaggcacaggatagacattaccattccaaaagggagaaaccagaagaaagagcttctaagcaagtccaaaacctagccaggcaaatcccattacatcttaaggctagagaatcatcctctttggctccacgctctgccctccaggccctctagggtagtggctttgtccctgagggctgtggtcagaggcagctgggtttgctgtaactaatagaggtggccctaccctgtgaaatcaaggagtaggcaggccttccctgagcttatatactctgtgtctcggtggcagtggcagcactgggggtctctaaattgcccttgggatcatccttccttttcttgaaggacaaagaatgtttgcatccaggtagctctgctgtcagaagtccaaaagccttactttattttattccatgtccatcccctttagtgcaagatgccagtgtctctgctggtataatcccatctcttgtccttgcttctgctgagatggctgattaagtctaggtaatctctttagagggggagtgtccagccacacccttgacttttctctctgtaacactcttattttttgcaatatggatagcctgagaattttctgactctagttcctgattccctgttgcttaacaatttcttctttaattcgtctttttccttttgcattttacagtaaccagtaaggagaaaccaggttgtatcttcaacactttccttacaaatctcccctgctaaatatgcaaggttgtcaatcacaaagccacttctccatttctatgtagttgttacagtgacccctatctcatgatccaaatctgtatttagggttctccagaaaaacaagcagtaggattttttttatatgtaggagatttattaaaaggaattggctcatgcaagtatggattctggtgagtccaaaatatgcagcgtgggccagcagcctggaaacatgggagagttgatggtgcagatgaaagccaaaggcagtctcttgctcaggaaagtcagggtttttgttctgcccaggtttttcagctaattggatggggcccatccacattatggagggaactgtgcttactgaaagctcaccaacttaaatgttaatctccaaagattcattccggattgacacataaaattaaccatcactggaggtaatgataatagtctagataagacaggccagcaccaatagaggtttaaaaaaatctgagtgaaaatgggtattacagaccagaaaacataattggatgtgggagtaagtgcaaaattacaagcctttggttttgcaaagatggtggtaccgtttttctaaaatgcccagggcagaagacactgcacttactgagaatcattgctcagaaagtgattctccacctcggctacacatagaatcatctggaagattttaggaatctctgtgtccaagctatgctgcataccagttaaatctaaattcttggcgtaaggccaggcgtggtggctcaagtgtataataccagcattttaggaggccaaggcaggcggatcacctgaggtgaggtgagtttgagaccagcttggccaacatggtgaagccccgtctctactgaaaatacagacattagccggctgtggtggcacatggctgtaaatcccagctacttgggaggctgaggtaggagaattgcttgagcccaggaggtgaaggttgcagtgagctgagattgcatcattgcactccagcctgctgggcaacagagtgagactccgtctcaaaaataaatagataaatgaaacaaataataaatacattccggatgtgagaccgggcatcagtatttaaaaacctctctaggtgattccagagtgtaaccagccttgagaaccactattgaaagaagcagagtcatgagaagccttttaaaaaaattctgcctgcccaacaaaatcctggagtacatcagcccaagtttcatttctgtgcttctttattttcctagctggccttggtcgcacgggcactctgatagcctgctacatcatgaagcattacaggatgacagcagccgagaccattgcgtgggtcaggatctgcagacctggctcggtgattgggcctcagcagcagtttttggtgatgtaagtagtagcctacgtctgtagttcccagggaacatgtggggttggaatctgatggggagtggaatttcctttagtttccaacaacaacagataatctggtaggaagaagttgttcatgtatctttctggaaagctctattttgatgttatttaaatgctctaggaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccggtaatcaagccgtttctgttgcgatgttgttactgctttaactgctattgagaacctgtcagggtatggagaaaaccgtaggtaaaataataaagcagctcttggatgattgtcagttttttatatttataaccctctctaggcactttttacccaaaatagtggaaacaaggttgtgtgtccataaaactatgttttacttactcagcaggtgcataaaaggttgtgaagtgagctcttcagccagatctacccctgcccctcacccctttttgccatttcacaacagctgatttaggaaagcaatcattctcaaatagagagcttttaacaaatcaaaggcttagggggtagcagtactactacattaagtggtagtaagtacactgagattttaaaaagagcgttttcaaacttgaaagcccattaaccctcttcactgttgatgtgttttctaacaagagtgctgctgtgttgtctctgaaagtcaactttggctgtcttaaaatgtcacctgaagcttgattgtgaaagggaaaaatattctagagcttgcagaaacttggactgtgttcatgtggataaattgctgctctgctgtactgcattaataagtgcaacttaaatcattagctcagtgtttttttacttacacagtacagtgatgatgacgaaatcaatggagtgacacaaggtgatagacttcgggccttgaaaagcagaagacaatccaaaacaaacgctattcctctcacgtgagtctgggttcctttgttgtggttgatgtttcttcatatgtgtgtggggtccttggtgagggtttttcctgtacatttttctccatagttgcaagcccatgatgccactttgaaatgcttgcctatgttatttaaaacctaggggtgctggccttggaagctctcagctgtcccttgtttaccttggtcctcatgagcctttatgggtgggaaggcgacatcagggatactttttctccatgaataatcagcatggggcatcctcaggagcgcgacagcagatgtaaagcccaggatgccagacttgtccatagttactaaagtggtgtatttctttacatttgccatgttgcagatcatttgttttgataagcatgacatgatggcttaatgacattatgttgttttggggcaacaatgaactggtctaaactatattttgggtttttcgtttgtttctttggggaatgattttctaattatagaggaagatttagcctgagaataggaaatgttgtagtactgagtgtatgtatgtctatgtgtacattcttgtgaatgtgtgttagttgggattcaacctgatggagcatccaagattgttagaaaaatatgcagaagcaaagtacatgaccatggtattttttgtaggctgttctttagtaaatgctcccacttgttgccattggatttcttccttctagttacttcctttttcattgtgggacaccagatttccagccttcttttttgcggggagggagtgtgatggacatagatcatttattcagtaagcatcttgtaatatggtaaggaagtatgatataatataccatttatattggcagagaacaggttttcttttcaattaaaagtaattcctcactagtgtctcgtcataaaaattctgaagtagaattacacctaaggcatgtgtcattatgggttgctcccctgggaggttcttcttaaaagacccaaggcaaagaattgagttttacaatatgcagtgttatgtgaatgaatgtagggcatccattttgattataggcatttattaagcatttcttttgcaacttagtggtactttagtcaactatacttttttaaaaatggtgccttttggccaggtgtggtggctcatgcctgtaatcccagcactttgggaggccaaggtgggcagatcacctgaggtcaggagttcaagaccagcctggccaatatggtgaaaccccgtctctacaaaaatacaaaaactagccgggcatgatggtgggagctgtaggcattataggatcccagctactcgggagggtgaggcaggaggatcgcttgaacccgggaggcagagattgcattgagccgagatcgtgccattgcactccagcctgggtgacagagtgagactctatctcaaaaaacaaacaaacaaacaaaaatagtgcctttgtataatttacttaactccaaatgccattttgtttttaatttccttattaaaagtcttcacctaaggccttaatggtttttctttggaagtattatggtggctccaggtaatcatccagatactaattctggatgtggtggaggaggcaggcagcaccctcgagcagtgcttctcagacttcagtgtgcaggaggcacccgggcgcttgttgaaatatgggttatgattggtggggtgggggtggggcccaagagttcacatttctatccgaggctgctggtccagggaccacacattgaattgcaagccctaggaaactgatgcttttgtgggttgattttagctgtgtctgggattttttgttttgtttttcagaatcagcatcatcagtttatgttttaatattttgttgcctgctgttcaaaagtcaagttgagagtcaggggatacaaatcctgcttagtcaaaagtttttgttaaataggaaatttcctttagtcaccctctgaatctgctactctcattaacgtgagttcaaatctagctgggcgtggctgtgcgcacctgtagaccaggctatgcgggaggctgaggcaacaggactacttgagcccaggagtctgaggctgcagtgagccatgatcactgcatccagcctgggtgacagagtgagaccctgtctaaataaataagtaaaatcaagtacaatggtaaaagttaaaaaacaaagaggtagctcaggattccttttggtaatatcccaaaaacaatatatataaatagccccacataacacaaataacaaagttttaggccacacttttaaagaagaaagcgaaatgctagtttttctaagctctgagttatgtgtatagacccgaggggatttttgatgagtctcagcaaatctccttcctcctcccttacaacattttgcttatccccgtctctgctttttcaaaccctctctgctattatttgcagttttttggccctagaaaagatcaattgaagattttctttctttccctcttgtgtctatgttgttattttaggaatagaagtccctgagggactgttctcaacagttgcttgggttgaaaaatacaaaatcaatttcttcatccaagtttgactcattgatttctgtgagcaagttattttgctttagcattggcacttagccttatgaaaatacagtacatgcaagaaggaaagttagtgagaaatacacaagtactagtgattcttaggagaaggttatagtacataaaatattattccaatgattggtttctctttttttttttttttttttttttaagacagagtcttgctctgttggccgggctggagtgcaatggtgtgccctcggctcactgcaacctctgcctcccaggttcaagtgattctgctgcctgagcctccggagtatctgggattatgcaccaccacacccagctaattttttgtatttttagtagagacaaggtttcaccatgttggccaggctggtctcgaaatcctgacctcaagtggtacacccacctcagcctcccaaagtgctaggattacaggcatgaaccaccggcgcctggccggtttctcttttataaatggtcagttttgggggagagtttaagtttttagtgattataaaatggccatttgctcagcctgtctgatcctgactacaatgatgacaggaaaccatgtggcaccatgacattgagctgatcttcaggacgtgatgacaagtatattgtctgtgctaaaatggatttggtagattgcataacttgagccatgaggcctgtcgttctgcatactgatggttttggtaggtttggagatgagtatatctgttagcaatggaaaataattctttttttatttttattttttatttttatttttgagacagagtatcgccctgtcgcccaggctggagtaaagtggtgcgatctcggctcactgcaagctccgcctcctgggatcatgccattctcctgcctcagcctcccaagtagctgggaatacaggcgcccaccaccacgcccggctaaatttttgtatttttagtagagacagggtttcactgtgttagccaggatggtctcgatctcctgacctcgtgatctgcccaccttggcctcccaaagtgctgggattacaggtgtgagccactgcacccggccggaaaataattcttaagccatgaggtttactagaggaaaaagtaaccatctataatgctgacacttggacattcgggccattctgcctttaaggaactgaaggtgaaggctgggatcggtagagagttctctagggctcccagaccatttattcattccatttaaatattcacccctgtgatctttatgtatattagtagcttgttttttttgtgggaagattaaataagatggtgtgggtataacttgtggggtaaggttaggctgtatttcgagttcaccctttagtctaatccctttccacaatataggatgcctggcatgtaatttctttttccccgagacagagtcttgctttgtcacccaggctggggtacagtggcgtaatcttggctcactgcaacctccaccttatgggttcaagtgattctcctgcctcagcctcctgagtagctgggaatacaggcacacgccaccacgcctcgctaatttttgtatttttagtagagatggggtttcaccgtgttggccaggctggtctcaaactcctgacctcgtgatctgcccgcctcagcctcctaaagtgctgggattacaggcgtgagccactgcgcctggcctgacatgtaatttttaatgatgacagtgatgaggtcaacaataaaaatgacatgataagccaaatcagccatttccaaattgattagcagtactctgcacacagcagatgctcagtagaggctctaatatttggtcacagatgtatccaggtgaccatttggaagtatagtcattggaaagagcttctgcccttccaaatgggaggaggtttccttcctcactgctagaacccagaccaatggattaagaaacaccaagctgaggctggacacagtggctcatgcctgtaatcccagtgctttgggagttcaaggcagcaggatcacttgagcccaggagttcgagaccagcctggccaacatagtgagattctgtctctacaaaaaaaataaaaaaaaaaaactgggcatggtggcatgaacaggcagtctcagctgctactcaggaggctgatgtgggaggattgcttgtgcctaggagttggaggttacagtgaactatgataacgccactgcactccagcctgggcaacagagcaagacccctgtttctttctttctttcttcttctttttttttttttttttttttgagacggagtcttgctctgtcgcccaggctggagtgcagtggcgcaatcttggctcactgcaagctccacctcccaggttcatgccattctcctgcctcagcctcccgagtagcgtggtgcctgccaccacgcccggctaattttttgtatttttagtagagacggggtttcaccatgttagccaggatggtcttgatctcctgacctcgtgatccgcccgcctcagcctcccaaagtgctgggattacaggtgtgagccaccacgcccggcctttatttttttttattttttttattttttgagacagagtctcgctctgtcggccaggctagagtgcagtggcatgatctcggctcactgcaacctccgcctcccgagctcaagcaattctcctgccccaacttcccgagtagctgggattacaggcatatgccaccacgtctggctaatttttgtatttttttagtagagacggggtttcaccatgttggccaggctggtctcgaactcctgacctcaggtgatccacctgcctcagcctcccaaagtgaaaagatttcgggaaataggaactaccctttagtcgccctctgaattctgctcctctcattaacgggagtgtaaatatagctgggcgtggatgggcgcacctgctgaccaagcctgtgcgggagggtgaagcaacaggacctgcttgggcccagaagtctgaggctgagcttaagccatgatcattgcatccccctccgggtgaaaagaatgaaaaccctgtcttagacaaaacaagcnnnnnnnnnnnnnnnnnnnntgttttttttaatcaaagctctggattaggaattcttatttaaatttttttttttttaaatttttttgagacacagtcttgctctcttggccaagctggaatgcagtgacacaatcatagcagcctccatttcctgtgctcgtgatcctcccacctcagcttcctgagtagctgagactacaggtgcacaccaccatgcccagctaatttttaaaaaaattattagtaggccaggcacggtggctcacgcctgtaatcccagcactttgggaggctgaggcaggcaaatcatctgagatcgagagttcaagaccagcctaaccaacatggagaaaccccatctgtactaaaaatgcaaaattagctgggcatggtggcacatgcctgtaatcccagttgcttgggaggctgaggcagaattgcttgaacccgggagggggaggttgcagtgagccgagatcacaccactgcactccagcctgggcgacaagagtgaaactccatctcaaaaaaaattaaataaataaataataaaatagagctcaggtgcgatggctcacgcctataatcccagcattttgggatgctgaggcaggcggatcacctgagatcaggagtttgagaccagcctggccaacgtggtgaaaccctgtattaaaaatacagtacttagccgggcgtggtgatgtgcgcctctaatcccaactactcaggaggctgcagtgggagaattgtttgaacctgggaagcggaggttgcagtgagccaaaatcacgccattgcactccgggctgggtgacagagcaagactccatctcaaaaaattataataattaaaaaataaaaaataagaaagaaacaccaagctgaaagccaactagtatgaggaaaatgagtgtggaaaacaactaagaaaagtctatagtatgcatacctaagtgaaattttgctcattttgtgttgccctgggttaaatgtgaaccatattataaaaatgtgccattcccttagcttcctggatggctcaggagttagtaactcccttgaagtgagatcagttctgctgtattacgttcatttttagttgtgcctcctgtgattttgttaactagtctggggttttgtgtttttttgtttgtttgtttttggttatctggttttgcctcctttgccccttgtggtttgctttagttttctgtgtgtgcacatcttctgctttttgaagaacctcaatcatttatctgtgactgatttcagtatcataaagttaaattaacatggggtagttatctcactagtgactgagtcccaaagtatgaaacctgtttaaacacagcatttttttattcaacataaaatggcaaaactccatccttgttgaccacccctttgtatccctgttgctgttggctgggcttttagggtgtctaaaattcacatatggcttgattgattgatgattgcgtaatttattttggcttcccaatttgaacatctgttctttccccttcacccctttccagatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctgtaagtgtcccgttctgtttctctgccgttgcttacttctggtgcctagtgtggttcccacaatgcatgtttttctccttgtcagctcctagctttgttggtttgcctattttcaaaggttctttttctgaatcttttcaattaatgggatggtggtggggagggaaggtgggcttcactgttcctctcatagaaaggatattgaaagtaacatacgttgttttaaagttatgcttatccttaacatatttcaaaatagcagttgataaagacactgaaacagtttttcttcactgaaacagtttttcttccctatcaaaagtagttagcttaggataattggggtggttttattttcgtcagttggctatacaatttccctctagttttctgtatcttgagtatgtccttcccagtctagcaaagaagcatttttcccactgatctactttcattaaatatgtgattttgtagcctcgaaatctgccattgtacagcagctctctcataagtcttctctctttagtgtgcagaatttcctgctctgtctcattttcctcctcccctttagggaatacagtaagtacagtgtgtagcacttgatgctaaatgaaagtaggaggtcggagctgaggtcgcctgtttaaattggtgcatttccatatgatggtcattgttcctgcttttctccttgcccagacatagccagaatgcctttaataggctaatagcagcaaatctgtattctcttgagatctttcatctttgaaatgaagaccttaacagcgaagaggctttatttctgcagaagaatgtacaagaggcccacttgtggaacagcatgttgaagacccccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaacctgcttaacttgctcctatttatggcattttcttgaatatcttacaaataaaagcttattgtcgcgcattcagacctgctgtatttctgagatagattaaccttttgggtgttttcttctttacttctcttagtcaactacgattgccacatattctgactcaagagcatcatgcactacatagagttattcttctcaaactgttccaagtggcaaagatgttctgaatgggtggagcagttgcaaataatgcttaggcactttgtggttgaatgatcattcccagggtaagtttaaacatggtctctatcaggctctcttcttttcagtattccatgtaaactataccttctgttgttattggtaatgacgtttgccattgtatttctagacccaagcagagtattcagttcagcctgactaattatttggaattttgagaagcaaaaagcttgtgacagttacagtggtgttaatcagtatcatctttgtagcacccccatgtctttctctcaaaagggttttatttgtaaggtggtgactcctgagctccaccatcctctgtcatcaccacccacctctgctggcagtggacgcaggtggtgtggcatcgtctgctaagttgtttccagtgaaaagctcctgttatgcagcatgcctggagaattaggccataacaacacttcaggcttctgagtcagactcagagatagtgggaaagccttctctggaggctgcagggcctcagggtcacctttgtgcacgctcttgtggtgtccggagtggacagccagtatacatagtgcatagttgccctgatggatttttttcttggaattggacatttatgttcgagacctggctttttagtttttggctttgccgtgttccttgggttgcagatttcactatatctgaaatctcagagtaccgaggctccaaggatgctgcagagaagaaggtgaactggaatataggcaagaggtaggtaggatggaggattttgtcagggcagatgggaaggaagaaaatacatctgctgcacactgctctgcaaagccatgcttggcctgggttggaaggcagaaggccgcgagtgcccgggttccctgtgacagaggcaacacgtcaccctctggtgcctgtcaggtggtgtgtgctgtcactcatgatagctcagtggagttctcccccaaccccgatttcatcagtgcataacctgcagttaggataaataccgtgttgtcagtgcaaataactggagtcttccgtggtgtggttaatacactcaagttctatcattctcttggttttaaagttccacagaaattactagctatttaatattattattatattagttcactttaatttacactaattttatagagaaataaatacttttaaaaagatgttttccagcagcctgagaatgactacaggatttagcagtagtgtcttgttttgaatggcatttaaacacttcagtcatagttttaatttgagaaatcaggattcagatttcctaagcaggcagtgtatcagctcttgtttttttctcagattaattattttgcagtgtgattgttgtctgtacttttggccaaccgtggcctcaaattatttgagaattaggtgttgtatttaaaaaaaaaaagccaacaggagtcttgttttctccgtgcgtaagggagtggccgaggggagcggatgagaacagtggcagcacgagtgccccggcctgggcttcagaagtagcaatgaagcagcagcagtttgttttgttttgtttggttttatgcaaaattctatattcaaattcttagcagagatgaataaatatttccccatcactttatataaacaaataatttttagggatgggcagactggctcatgcctataaatcccaacactttggaaggtcgaggaaagagaatcactgaggccagaattttgagaatagcctgggcaacatagcgagaccccatctctataaaataaaaaatgaaaaaattagctgggtgtggtggcatgtacctgtggtcccaactactctggaggctgaggtaggaggatcaattgagcccaggatttgaggctgctatgattgcgccactgcactccagcctgggcaacagagtgagaccctgtctcttaaaaaaaaaaaaaaaaagaaaaaaaattttaaaaacaattccttgtttttagaagtagaattcacaagccagggtaatagttgtctttaatcatacaattaagatgcatatacactcttcttttttttttttatacaaagtctctatcacctggctggagatcggtgacacaaacatggctcactgcagtcttgacctcccaggctcaagtgatcctcctacctcaacctcccaagtagctggaaccaaggcacgccccaccacgcccggctaattattattattattttatagagaggatgtctcactatattttagaatttgggcttcttaatggtgtcttgtttcatgactgaaaatctgagaagctacttttacttttgggcataaagacttgtttggctggtggatttctttggtgtgggaattgcttaaaatgtccaggctggtctcgaaattttggcctcaagtgatcctcctgccttggtctcccaaagtgctggaattacaggcataagccaccgcaaccacctcctttttctattttgttagaacattcaacatatcagatgatcacactctaggagaatttctgaaccaaacattggctgatttatccaggattcatgtccctctgtgagacagaaagctagtttcatggggccctcagaaatcctgcatgagtaaagtgaaatagtggggaaagctgcccatccccttctccccagaaggcttgggaccgctggcccagacaagctccaggttatgctctggttgcggagtctcgctctttggcccaggctggagtgcagtggcacgatctcggctcactacaacctctgctgcccaggttcaagcagttctcctgcctcagccacctgagtagttgggattataggcacctgccaccacactcggctaatttttgtatttttagtagagacggggtttcaccatcttggccaggctgctcttgaactcctgacctcgtgatccaaccacctcggcctctcaaagtgctaggattacaggtgtgagccaccgtgcccagcctcttgttgcttttttagtgatgagatgtttagcattttactaaatgttggatatgctttggtttgggtcatgctaaggttgtagaaatttattaatcttagcctattttaaggccctgtctttggtatattagccagcatggtggtagctgaggcccgtgaggtgggatgctcactaattgtaatggttcaactttttactcctttgagctgggttctcataagttgttattggctttctcacctttatgtttgaataggagagaagaaagcttgttaagtcagtattttctctttcagagaattaaaagttggtatctataaatgtgtgtatatgtgtttagtttgtcattgattatctcttgaagaaaagaattgcatataggcctggtgtggtggctcacacctgtaatcccagcactttgggagtaagtgaggtgggcgaatcacctgagatcaggagttcgagaccagcttggccaacatggcaaagcctcatctctactaaaaatacaaaaattaaccaggtgaggtggtgggcgcctgcggtcccagctactcaggaggctgaggcaggaggatcgcttgaacctgggaggcagaggttgcagtgagtcgagatcacgccactgcactccagcctgggcgacagagcaagactccatctcaaaaaaaaaaaaaaagaattgcatataaaatcttttgatgtcttctgctgttttccctataacaatttaaagaggaaagaaaaaaaaaaaccaaaggaccatctgcctcttaaaggacattccgtgtggcctttatctcaggatgttcttttctgattcatcgtgtgcttcctcctgggcagcctactctcatatgcaccagtttctcaagctttttagagtttaattaaggcaagctttacaaaatttaagtgttttcactttcattttagtggcacttggagatttagtaagtgttatatataattcaggcaaaactcatattttgcttaaacactttctaaaattttgaaacgttatataaaattagtattgatttagtggattattacccatacttacagctttgaagagtgaatattgtatagttatttcctaaatttatgttcctattctttagaatttgagctcttaatggtgtcttgtttcatgactgaaagtctgagaagctacttctacttttgttgggcacaaagatttctttagctggtggatttctttggtgtgggaattgcttaaaatgccaagtcattcgccttccaggagcaaagccctctggttgtctttgtgtaaccttcaaagagaaacgagatgcttcattttaaaaggccttgatgtgaaaatgtgtttcagatttttttggtaaatgtgttgatggaaaatcctctcaattctcaagataatttgcactaaagtgcaaaaatactttcctctgtcaagtatttgcaaatggtttcagtgaatataatcttatttttttccaactattttcagagtaattcttcaatccagtgttcagagctgtaaaacatctgaacctaacatttctggcagtgcaggcattactaaaagaaccaccagatctgcttcaaggaaaagcagtgttaaaaggtgagaaaagaatcctactcttctgaaaagttgcaagcgtttgttttccagtttaatatttggaccctacctctggagactgacatgaaattaggagaaagtagagtctctgtgatgggaaattcatcaaatgtgtattccttgttcattatctaagaaaatctggaccattttaatgtaggcttttgttttgttttttagaagtaattctcaacactggaagtatggtctctgggtcatgatatgggaaagttttaagttaagaatttccaaagctggctgtcaggacttggaggacatttttctaggtgtatatcagatacagcatcattgctggacgattagctgcaaatgaatgtgatggtagaaatgagataaccagagagtttgaagatccttctctacctagtgactctttgtcctcttggccacagcccacacccgaggcactagttctttcactgtcgtcactgtcttcagtgagtgtaggcagaatttcacaaggaaaccaatgtgttctgtggccacgtcggtgactctgttgtctttggatatttctcatgaagtggacatgtcatttttaaagtattctgaaaacagatcccatctgaagagagaataaatagcccaggagtggaagtggggatagatggctcaggagtagaagggggcaccttttcatcgttgcctggtgttggcagcccatgcagtcctgtttctgtcctcctggtaaaaacgatctcttctaatagacatgagcgacctgaagataatcagaaccagactttaaaatgtcctgcacgtgtaccctgcttcttttcagcttccctgccatgtatatccgaggctttgggcctaggggccttatcagtgtgaaattagtccccagtgcaaagcagccagtctcccaagagaccttggcagagctgggagttctgtgtgctttgccttttgaagactcattcagctctgccatgtctcctctacactgttttgtacaaccttactgcacacttaacactcgcatggggatgcagcagtgccccggcataaggattggaggactgtcaggcactgactcatgattccaggatttaaaatttttcattagaaatgtaccaaatattcctatttctttactgtttgattcttcttgagaagaatattagagaaatactgaccaaaggtcaaagatttcggtacattggaacaatagcggagtgttatttataacagtgagaaacaggaaatgggctcaagattgttacattatgccaaatgaattgggagtcatacagtttagtacacgaagcagtaagtgaaaagagccatgcataacaattctgaagtatgggccgggtgcggtggctcgcgcctgtaatcccagcactttgggaggcggaggcaggtggaccacttgaggtcaggagtttgagaccagcctggccaacatagtgaaaccccgtctctactaaaaatacaaaaattagccaggtgtggtggcaggcacctgtggtcccagctactcgggaggctgaggcaggagaatcgcttaaacatgggaggcggaggtttcagtgagtcatgatcacaccactgtactccagcctgggcgacagagtgagactctgtctcaaaaaagaaaaaaaaaaaattctgaagtatgactctaattttgtaagcgtaagtatactatatatgtatagaaatatagagatgtataaatatttatatacctacaatacatctgtatttatagatgagtaagtttctatatatgcatagaaataagacaggaaaaatatgctatgatactaataaaagttctggttggtgggacagttgggatttttttcttttttatcgtcttattttccaatttttctacaataaatgaagggaaatgggagtgttttaactgacactttttggtgagccaagctattaaaaattcaggctgggcgcggtggctcacgcctgtaatcccaggactttgggaggccgaggcaggtagattatgaggtcaggagttcaagaccagcctggccaagatggtgaaactctgtctctactaaaaatacaaaaattagctgggtgcagtggcgggtgcctgtaatcccagctactcgggaggctgaggctggagaatcacttgaactttggaggcggaggttgcagtgagctgagatcgcgccattgcactctagcctgggcaacagagcaagactctgtctcaaaaaaaaaaaaatcaaataaaaagcctatcgttgatgacagttaattgttaattttgacatgtcttgaaggggcatattctttttaggtatgagtgctcaggcttttttttttttttttttcctttgacatggagttgcccaggctggagagcagtagtgttttctcggctcactgcaaacttcgtcttccaggttcaaaccattctcctgcctcatcctcccgcctcatcctcccaagtagctgggattactacttgtgggtggcatgtgccaccacacctggctaatttttgtatttttagtagagacggggtttcaccattttggccaggctgatcttgaactcctgacctcaagtggtccacctgcctcagccccccaaagtgctgggattacaggcgtgagccacggcgcccggccgctcaggcttttgttaacagcgtagtgtgtcttgcacatttaattctgctgtttgcttttttagattatgctttttaggttacagaagagtagagtccgggagcctggctggcacttgccaggtcatatcgtcttcctgtgaggaaggaagggctggccttgcctctgtttttctatctaggtctcgttgcgttttcatgtcactctagtaacctgaactcctgcctctctggagaagtggttcctggttgcagcaagcatctgcctcaggtccctggcagggatgctttgagggtcctaaggtagatttcagagtcagtaatctggactgaatgttgaaatgacccaaagcagcttccaggaatttgggatagttctgaaaaccaaaaagacttcttttaaattccaaaatggactttcagagatgatgtggagagcaaaaggagtctaacagtgaggattaactgggactcacagtttatttccccaccttcctctaagtgggttctttctttgtgcctcttttgggactttgtcctgtgttcacatcaccctacctgttatccacctacagcttacaaaagaaaggcaaattatgtataggttttaagaattggagttagccaagctgtagcctggagcttttatcctactgaatattattcataatatcatactaaatagtattcatttctgtttggagggcaagagggaattagtatattggtgcacggtctgattctggacaaaatagtatgagctaagattgttgagtaaatttaaagtattgagttgaaatctttaaacagcagtagaaaaaaaaatagagcacccttttggggtcctttcatccctacctgcaacgtagcaggtttaccagttcctactggtttgtcatcatctctgcggcacatgggaacttgaccttccattttcatgttccttggcatccaggatgaagactccacccaaactcgctttgcgcttaattggtgcttttgatttttggttttactgagaggctcttcagctttggggaactttttcaaaaacgtcaaaagagcaattacttggggcagctgaaaaaataggagtgatgtcttaactatttgtctttgggaaaaggtgccactgtttctcacagaagatgactatcccctcgtgtatccatttgaagctgtgccacatcgaaacctaaatctcatgtggccacaggtctgggacggcggccaggcagcctgtgtggccctcggtcctgccagggctctgtgtggcaccttctcattcccttccctgagtctggagagggaggtgagtgggcttctctacctcccacttcctgttagagctataaatccatgctaacctttctcttttaagaattaataaatccagtgaataattggctccgttgaatcggcctgttttcagtgttctcacatgacctctctgaagagctctcttagaacagtcttggaaatttcatcatgccccgagtgagagcctgcagccacctcatttgctcgcattcactcatgtcttcacgcagcccttccgctggtgcgtgtttgttagcttatgctgtttcttttgggcaggctcttctttttttaaaatgataacttcattcattttctaagaaactggcatgtacaagttactttaattctgagttgtatcactaggaaccatcactttctgctgcagctgccaaaccaaacctaaggtccggggctctggagtgctttgtacctaattcttcatattgtgggggctggggagagaaatgctcaggttctttccttagcatcttttttttttttttttaaatgagacagagtctcactctgttacccaggctggagtgctgtggtgcgatcttggctcactacaacctccacctcccaggttgaagtgattctcctgcctcagcctcctgcatagctgggaatacaggcgtgcatcaccacgcctggctaaaaattttcttctgtatttttagtagagatgaggtttcaccatgttggccaggctggtcttgactcctaaccttaggtgatctgcctgcctcggcctctcaaagtgctgggattacaggtgtgagccacggcgcccggcctctttccttagcttctaaaaccacgagtgttttcaggagcccttcagttgggagcagctgcatctaggacctctaacttcttcagtgttctcgggtggctttgctggtgtcacacctgccactgcctcttgaccctcagagtctcagatctgggcacctgttccgttgcctctgggtgttaatttttggctactgccattatctccaaagtccatcaggagaggagtcccagaaggttgtctccaaatgtttctttgtaaaatactgtttctctccagtgttttaaaatattaatgatcctttgaaattccagatattttcccacttgtctcactagctggtctggatctttgactcagtgctctgttgggatctctgaaaacgaaatgatcgattcaaacgcttctccttgaagagcgcagcagcagcagcatcgggcgaggagccctccagattggaagtggtttttctgactcttattttggttttgtttgctttctgaaagttgttactgacctgaaagtgtagcgtcgtgaactggggaaggagagaagagaggcaggatgagaatcgtggagtgcggaggcaggtagcccgtggggtgcctcctgtgctcggtggagctggaagccgcttaggtgccagagctttttctgtgaccaaattctggcttttgaaataacccagtaacagttctctatcttttcattctgcccgctcctcccacagcctggtccctcagaggaaaggaaggacaaggagtgctttgcagcacgtgcccctggcggcgtcatggtactttcctggccctgctgcccctgcccgtccgtcttttatgatttttatttactcgtattggtttttttaaatttctattttttgcagaactgagcctttttctgccctgcctttctcctgtttgtctttcctttgtggttgatattgtgttgtcttctccaaagtatttgtcattagaaacttacagcaagcgtatactttttagcatgtcagtatttttattatgttgccctccttgtctttgataactgcctgtggacgctgtgtaaactttctggtaaaaatccttttttttccccctgtagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaacagcctttttgtttattgtgttacttaccaagcattttgaattctggtaggcagtgggttagatcataaagcagaggtaacccggaatctgtgtaagttttctaggacggccataatggaataccccagactgggtggctgacacagaagttcatttcctcacagttctggaggctgcaagtccacgaccaagctgtgggcgggcttggtttctcccaaggcctctctcctgggcttggaggcgctgcctcctcgcagggcctctctttggtgcctgcgtggccctggtgcctctcttcccctctactcccctctcaagaggacaccagtcagattggattggggcttaccccgatggcctcattttaacttcaccacgtcgttaaagtccccatgtccacatagagccacatctgaaggggctggggttagggctttagtgtttgaatctggaagttagtccagcccccttctgtagggtaaggtggtgagtgacagggggctcctgctgccaggccattcctcacaccccagcaccagctcacacaacacaaagttttgactttctgcagacctctaaagataagacttaagtcagtcaggctcttgggatcctgcagggcattttgcctgccaaggtcgggcggcaccggccccagcaccctccccagcttgtggtccaaccccggacgccagacccctgctttctacctgccttgcctctggtgccgggcaggaccccaagggctcagtgtccacacctcacacacagcttactgctgagactcaagaccctgtgttctgtcgagttctacccagttcccccaaggagctgtgcttggattcacactgggttacaagtgtccaaagtaaaaaccagagacctgccttctcgcccctctcccgactccacaccacacatgaccccccagagtgttcatttgcagaccctggctctgtgggagctgtggcctctccctgcccctccatggcttcccctgaggccactagagctctcccctgacccactagagctcaggcag

SEQ ID NO: 14384 - DNA, 7462 bp, Human
cagtatcttaatacataggtttttagactttgactagaagcttaagtcaaaggaatataagcatagtcaaagttagactcccagtcttggaatcttagaattacagggtcgcaggatcgcaggatcgcattctttagatttatggaatcacgttaggacaaccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggcccgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccacagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgcgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagtaaaaagaaacaggtgaggttaatttgaatgatatacttaacccaacatatcaaaaatattatgatttcaacatataatcaatgtaaaaattgagatgttttgctcttttacatgaagggtttacaatttggagtgtgttttacacttacagcttctctaaatgtggactagtcacctgctaggtgttcagtagcaacactgtgttgtgcagtgcaggtctaggtgctggcccttcctggctttggtggtggtacctggaagcacttgagcgctgaccctgccacccgtcggcccaaattccagacccagccttgtgaccttgaagagtgcaggtattgggccgccctcctctccctaagaatctttgcaggtatggagttcaagggttctccttcattcagctagacaagctggctgtcccaggtgcagaggtcaggatgacttgcctggttgagaagaatgggaaagtaagagttctccacccaggagttttgttctgggctgcagaagagcccaggcgtgggactggggctggagaaggctggtttttgcccttagtgccagagttgagcctttctctgtttcctaatgagcaagtccagtgctttgacagcaccactaatcttaagccagtcccttctcctctcgggtcgtcatttgtgaaatgggaatttgtgactgctacctcagataattttcctgaagttaaacgagaggagaggtgaaaagtgctttgtaaactgtaaagcgcagagcatagcagggctgaaaggctttaaataagcgctgccttgtaacaaagcctcctggagtgtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcattttatgaacacagaaaaatcgtttgtccctctccgggccctgcacccgccagcgtcgtgtgcaggcgtccccgggctgtggataactagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaactgcacactcatgacttggagctgccctgtggagttacagtttaccaaacacattcatgaacataatctcatttactaaaaactttgtgagaattttcttttactaaaattttttcttattacaaaatcagtagtgttcattgttttaaaagaaataacaggtaagaaaaataaagagggagggaaataacagcaaaaaaaaaaaaaaaaaaaaa
